US011421026B2

(12) United States Patent
Kretz-Rommel et al.

(10) Patent No.: US 11,421,026 B2
(45) Date of Patent: Aug. 23, 2022

(54) ANTIBODIES THAT BIND HUMAN CANNABINOID 1 (CB1) RECEPTOR

(71) Applicant: BIRD ROCK BIO, Inc., La Jolla, CA (US)

(72) Inventors: Anke Kretz-Rommel, San Diego, CA (US); Roger Ferrini, Solana Beach, CA (US)

(73) Assignee: Bird Rock Bio, Inc., La Jolla, CA (US)

( * ) Notice: Subject to any disclaimer, the term of this patent is extended or adjusted under 35 U.S.C. 154(b) by 149 days.

(21) Appl. No.: 15/765,135

(22) PCT Filed: Sep. 27, 2016

(86) PCT No.: PCT/US2016/053927
§ 371 (c)(1),
(2) Date: Mar. 30, 2018

(87) PCT Pub. No.: WO2017/058771
PCT Pub. Date: Apr. 6, 2017

(65) Prior Publication Data
US 2018/0282406 A1 Oct. 4, 2018

Related U.S. Application Data

(60) Provisional application No. 62/235,194, filed on Sep. 30, 2015.

(51) Int. Cl.
| | |
|---|---|
| *C07K 16/28* | (2006.01) |
| *C07K 16/32* | (2006.01) |
| *A61K 47/68* | (2017.01) |
| *G01N 33/68* | (2006.01) |

(52) U.S. Cl.
CPC .......... *C07K 16/28* (2013.01); *A61K 47/6849* (2017.08); *C07K 16/32* (2013.01); *G01N 33/6872* (2013.01); *C07K 2317/24* (2013.01); *C07K 2317/34* (2013.01); *C07K 2317/55* (2013.01); *C07K 2317/565* (2013.01); *C07K 2317/76* (2013.01); *C07K 2317/92* (2013.01); *G01N 2333/726* (2013.01)

(58) Field of Classification Search
None
See application file for complete search history.

(56) References Cited

U.S. PATENT DOCUMENTS

| | | | |
|---|---|---|---|
| 5,460,785 A | 10/1995 | Rhodes et al. | |
| 5,817,766 A | 10/1998 | Hui et al. | |
| 7,214,786 B2 | 5/2007 | Kovalic et al. | |
| 7,611,858 B1 | 11/2009 | Svetlov et al. | |
| 7,612,181 B2 | 11/2009 | Wu et al. | |
| 8,236,763 B2 | 8/2012 | Lotersztajn et al. | |
| 8,242,121 B2 | 8/2012 | Coleman et al. | |
| 8,258,268 B2 | 9/2012 | Wu et al. | |
| 8,518,653 B2 | 8/2013 | Takkinen et al. | |
| 8,604,060 B2 | 12/2013 | Lotersztajn et al. | |
| 8,865,163 B2 | 10/2014 | Epshtein et al. | |
| 8,906,633 B2 | 12/2014 | Benchikh et al. | |
| 10,227,406 B2 * | 3/2019 | Coward ................. | C07K 16/28 |
| 10,308,712 B2 * | 6/2019 | Kretz-Rommel ...... | C07K 16/28 |
| 2002/0102208 A1 | 8/2002 | Chinn et al. | |
| 2005/0095674 A1 | 5/2005 | Lewis et al. | |
| 2005/0282798 A1 | 12/2005 | Lazzari et al. | |
| 2006/0270655 A1 | 11/2006 | Swick et al. | |
| 2007/0044171 A1 | 2/2007 | Kovalic | |
| 2007/0071675 A1 | 3/2007 | Wu et al. | |
| 2010/0047239 A1 | 2/2010 | Wu et al. | |
| 2010/0216785 A1 | 8/2010 | Lazzari et al. | |
| 2011/0086364 A1 | 4/2011 | Takkinen et al. | |
| 2011/0110852 A1 | 5/2011 | Miller et al. | |
| 2012/0082667 A1 | 4/2012 | Yokoseki et al. | |
| 2012/0195900 A1 | 8/2012 | Ghayur et al. | |
| 2012/0201746 A1 | 8/2012 | Liu et al. | |
| 2012/0208213 A1 | 8/2012 | Benchikh et al. | |
| 2013/0004416 A1 | 1/2013 | Wu et al. | |
| 2013/0017202 A1 | 1/2013 | Epshtein et al. | |
| 2013/0065323 A1 | 3/2013 | Benchikh et al. | |
| 2013/0196354 A1 | 8/2013 | Fitzgerald et al. | |
| 2015/0004167 A1 | 1/2015 | Wu et al. | |
| 2015/0118763 A1 | 4/2015 | Fitzgerald et al. | |
| 2016/0145333 A1 * | 5/2016 | Coward ................. | C07K 16/28 424/139.1 |

(Continued)

FOREIGN PATENT DOCUMENTS

| | | |
|---|---|---|
| CA | 2915386 | 12/2014 |
| EP | 0634014 | 2/1994 |

(Continued)

OTHER PUBLICATIONS

Mariuzza, R.A. etal. The Structural Basis of Antigen-Antibody Recognition 1 Annu. Rev. Biophys. Biphys. Chem. 16:139-159, 1987.*
MacCallum et al. "Antibody-antigen interactions: contact analysis and binding site topography", Journal of Molecular Biology, 1996. vol. 262, pp. 732-745.*
De Pascalis et al. "Grafting of abbreviated complementarity determining regions containing specificity determining residues essential for ligand contact to engineer a less immunogenic humanzied monoclonal antibody", Journal of Immunology, 169:3076-3084, 2002.*
Goel et al. Plasticity within the Antigen-Combining Site May Manifest as Molecular Mimicry in the Humoral Immune Response.1 J. Immunol. 173(12)7358-7367, 2004.*
Kahn et al. 'Adjustable Locks and Flexible Keys: Plasticity of Epitope-Paratope Interactions in Germline Antibodies.' J. Immunol. 192:5398-5405, 2014.*

(Continued)

*Primary Examiner* — Nora M Rooney
(74) *Attorney, Agent, or Firm* — McDonnell Boehnen Hulbert & Berghoff LLP

(57) ABSTRACT

The present invention relates to novel antibodies and fragments thereof that binds cannabinoid 1 (CB1) receptor. The antibodies and fragments thereof as disclosed herein include humanized antibodies that bind CB1 receptor. The invention also includes uses of the antibodies for treating a disease or disorder responsive to antagonism or agonism of the CB1 receptor.

26 Claims, 66 Drawing Sheets

Specification includes a Sequence Listing.

(56) References Cited

U.S. PATENT DOCUMENTS

2017/0210797 A1* 7/2017 Kretz-Rommel ............................ A61K 47/6849

FOREIGN PATENT DOCUMENTS

| EP | 0736529 | 3/1996 | | |
|---|---|---|---|---|
| EP | 2487155 | 8/2012 | | |
| EP | 2500352 | 9/2012 | | |
| EP | 2698383 | 2/2014 | | |
| EP | 2995302 | 3/2016 | | |
| RU | 2470021 | 12/2012 | | |
| RU | 2518351 | 6/2014 | | |
| WO | WO 1993/008829 | 5/1993 | | |
| WO | WO03080672 | 10/2003 | | |
| WO | WO2005009479 | 2/2005 | | |
| WO | WO 2005/023232 | 3/2005 | | |
| WO | WO2008048648 | 4/2008 | | |
| WO | WO2008147518 | 12/2008 | | |
| WO | WO2009136382 | 3/2010 | | |
| WO | 2012007847 | 1/2012 | | |
| WO | WO2012160006 | 11/2012 | | |
| WO | WO 2014/210205 | 12/2014 | | |
| WO | WO 2015/148984 | * | 1/2015 | ....... A61K 2039/505 |
| WO | WO 2015/089449 | 6/2015 | | |

OTHER PUBLICATIONS

Poosarla et al. 'Computational De Novo Design of Antibodies Binding to a Peptide With High Affinity.' Biotech. Bioeng. 114(6): 1331-1342, 2017.*

Pertwee et al. 'Targeting the endocannabinoid system with cannabinoid receptor agonists: pharmacological strategies and therapeutic possibilities.' Philos Trans R Soc Lond B Biol Sci. Dec. 5, 2012; 367(1607): 3353-3363.*

PCT Application No. PCT/CN2014/074199 filed on Mar. 27, 2014, entitled "Antibodies that Bind Human Cannabinoid 1 (CB1) Receptor".

Adey et al., "Chapter 16—Preparation of Second-Generation Phage Libraries," Phage Display of Peptides and Proteins, eds. Kay et al., Academic Press, 1996, pp. 277-291.

Auguet et al., "Endocannabonoid Receptors Gene Expression in Morbidly Obese Women with Nonalcoholic Fatty Liver Disease," BioMed Research International, Article ID 502542, 2014, pp. 1-7, vol. 2014.

Boder et al., "Directed evolution of antibody fragments with monovalent femtomolar antigent-binding affinity," Proc. Natl. Acad. Sci., Sep. 26, 2000, pp. 10701-10705, vol. 97, No. 20.

Brusberg et al., "CB1 Receptors Mediate the Analgesic Effects of Cannabinoids on Colorectal Distension-Induced Visceral Pain in Rodents," The Journal of Neuroscience, Feb. 4, 2009, pp. 1554-1564, vol. 29, No. 5.

Carter et al., "Toward the Production of Bispecific Antibody Fragments for Clinical Applications," Journal of Hematotherapy, 1995, pp. 463-470, vol. 4.

Carter, Paul, "Bispecific human IgG by design," Journal of Immunological Methods, 2001, pp. 7-15, vol. 248.

Chanda et al., "Activation of Cannabinoid Receptor Type 1 (Cb1r) Disrupts Hepatic Insulin Receptor Signaling via Cyclic AMP-response Element-binding Protein H (Crebh)-mediated Induction of Lipin1 Gene," J Biol Chem., Nov. 2012, pp. 38041-38049, vol. 287, No. 45.

Chorvat, Robert J., "Peripherally restricted CB1 receptor blockers", Bioorganic & Medicinal Chemistry Letters, 2013, pp. 4751-4760, vol. 23.

Chothia, et al., "Canonical Structures for the Hypervariable Regions of Immunoglobins," J. Mol. Biol., 1987, pp. 901-917, vol. 196.

Cinar et al., Hepatic CB1, Receptors Mediate Diet-Induced Insulin Resistance by Increasing de novo Synthesis of Long Chain CeramidesHepatology, Jan. 2014, pp. 143-153, vol. 59, No. 1.

Clackson et al., "Making antibody fragments using phage display libraries," Nature, Aug. 15, 1991, pp. 624-628, vol. 352.

Database Geneseq, "Mouse anti-amyloid beta monoclonal antibody AL-208 mature VL, Seq 560", Database accession No. AYL01861, Dec. 9, 2010, 1 page.

Davies et al., "Affinity improvement of single antibody VH domains: residues in all three hypervariable regions affect antigen binding," Immunotechnology, 1996, pp. 169-179, vol. 2.

Despres et al., "Effects of Rimonabant on Metabolic Risk Factors in Overweight Patients with Dyslipidemia," The New England Journal of Medicine, Nov. 17, 2005, pp. 2121-2134, vol. 353, No. 20.

Despres et al., "Effect of Riomonabant on the High-Triglyceride/Low-HDL-Cholesterol Dyslipidemia, Intraabdominal Adiposity, and Liver Fat," Aterioscler Thromb Vasc. Biol., 2009, pp. 416-423, vol. 29.

Furukawa et al., "A Role of the Third Complementarity-determining Region in the Affinity Maturation of an Antibody," J. Biol. Chem., 2001, pp. 27622-27628, vol. 276.

Goeische et al., "A Recombinant Humanized Anti-Insulin-Like Growth Factor Receptor Type I Antibody (h7C10) Enhances the Antitumor Activity of Vinorelbine and Anti-Epidermal Growth Factor Receptor Therapy Against Human Cancer Xenografts," Int. J. Cancer, 2005, pp. 316-328, vol. 113.

Gram et al., "In vitro selection and affinity maturation of antibodies from a naive combinatorial immunoglobulin library," Proc. Natl. Acad Sci. USA, Apr. 1992, pp. 3576-3580, vol. 89.

Greenwood et al., "Structural motifs involved in human IgG antibody effector functions," Eur. J. Immunol., 1993, pp. 1098-1104, vol. 23.

Hollander et al., "Effect of Rimonabant on Glycemic Control in Insulin-Treated Type 2 Diabetes: The Arpeggio Trial," Diabetes Care, Mar. 2010, pp. 605-607, vol. 33, No. 3.

Idusogie et al., Mapping of the C1q Binding Site on Rituxan, A Chimeric Antibody with a Human IgG1 Fc, J. Immunol., 2000, pp. 4178-4184, vol. 164.

Jeong et al., "Paracrine Activation of Hepatic CB1 Receptors by Stellate Cell-Derived Endocannabinoids Mediates Alcoholic Fatty Liver," Cell Metabolism, Mar. 2008, pp. 227-235, vol. 7.

Jourdan et al., "Activation of the Nlrp3 inflammasome in infiltrating macrophages by endocannabinoids mediatese beta cell loss in type 2 diabetes," Nature Medicine, Sep. 2013, pp. 1132-1140, vol. 19, No. 9.

Kabat et al., "Unusual Distributions of Amino Acids in Complementarity-determining (Hypervariable) Segments of Heavy and Light Chains of Immunoglobulins and Their Possible Rolees in Specificity of Antibody-combining Sites," J. Biol., Chem., Oct. 10, 1977, pp. 6609-6616, vol. 252, No. 9.

Köhler et al., "Continuous cultures of fused cells secreting antibody of predefined specificity," Nature, Aug. 7, 1975, pp. 495-497, vol. 256.

Kuang et al., "A Novel Monoclonal Antibody Against Cannabinoid Receptor 1", Hybridoma, 2012, pp. 131-136, vol. 31, No. 2.

Kufer et al., "A revival of bispecific antibodies," Trends in Biotechnology, May 2005, pp. 238-244, vol. 22, No. 5.

Kunos et al., "Should peripheral CB1 cannabinoid receptors be selectively targeted for thearapeutic gain?," Trends Pharmacol Sci., Jan. 2009, pp. 1-7, vol. 30, No. 1.

Labrijn, et al., "Therapeutic IgG4 antibodies engage in Fab-arm exchange with endogenous human IgG4 in vivo", Nature Biotechnology, 27(8):767-771 (2009). Correct citation and name.

LeFranc, et al., "IMGT unique numbering for immunoglobulin and T cell receptor variable domains and Ig superfamily V-like domains," Developmental and Comparative Immunology, 2004, pp. 55-77, vol. 27.

Lin et al., "Cannabinoid receptor 1 disturbance of PPARY2 augments hyperglycemia induction of mesangial inflammation and fibrosis in renal glomeruli," J. Mol Med., 2014, pp. 779-792, vol. 92, No. 7.

Liu et al., "Hepatic Cannabinoid Receptor-1 Mediates Diet-Induced Insulin Resistance via Inhibition of Insulin Signaling and Clearance in Mice," Gastroenterology, May 2012, pp. 1218-1228, vol. 142, No. 5.

(56) References Cited

OTHER PUBLICATIONS

MacCallum et al., "Antibody-antigen Interactions: Contact Analysis and Binding Site Topography," J. Mol. Biol., 1996, pp. 732-745, vol. 262.
Maddipathla et al., "Augmented Antitumor Activity against B-Cell Lymphoma by a Combination of Monoclonal Antibodies Targeting TRAIL-R1 and CD20," Clin. Cancer Res., Aug. 1, 2007, pp. 4556-4564, vol. 13, No. 15.
Mallat et al., "Cannabinoid signaling and liver therapeutics," Journal of Hepatology, 2013, pp. 891-896, vol. 59.
McCafferty et al., "Phage antibodies: filamentous phage displaying antibody variable domains," Nature, Dec. 6, 1990, pp. 552-553, vol. 348.
Milstein et al., "Hybrid hybridomas and their use in inmmunohistochemistry," Nature, Oct. 6, 1983, pp. 537-540, vol. 305.
Miranville et al., "Reversal of Inflammation-Induced Impairment of Glucose Uptake in Adipocytes by Direct Effect of CB1 Antagonism on Adipose Tissue Macrophages," Obesity, 2010, pp. 2247-2254, vol. 18.
Moreira et al., "The psychiatric side-effects of rimonabant", Rev Bras Psiquiatr., 2009, pp. 145-153, vol. 31.
Mueller et al., "Humanized Porcine VCAM-Specific Monoclonal Antibodies with CHimeric IgG2/G4 Constant Regions Block Human Luekocyte Binding to Porcine Endothelial Cells," Molecular Immunology, 1997, pp. 441-452, vol. 34, No. 6.
Nahta et al., "The HER-2-Targeting Antibodies Trastuzumab and Pertuzumab Synergistically Inhibit the Survival of Breast Cancer Cells," Cancer Res., Apr. 1, 2004, pp. 2343-2346, vol. 64.
Nicolaou et al., "Calicheamicin ϴI1: A Rationally Designed Molecule with Extremely Potent and Selective DNA Cleaving Properties and Apoptosis Inducing Activity," Agnew Chem Intl. Ed. Engl., 1994, pp. 183-186, vol. 33, No. 2.
Novellino et al., "A listing of human tumor antigens recognized by T cells: Mar. 2004 updated," Cancer Innumol Immunother., 2005, pp. 187-207, vol. 54.
Osei-Hyiaman et al., "Hepatic CB1 receptor is required for development of diet-induced steatosis, dyslipidemia, and insulin and leptin resistance in mice," The Journal of Clinical Investigation, Sep. 2008, pp. 3160-3169, vol. 118, No. 9.
Osei-Hyiaman et al., "Endocannabinoid activation at hepatic CB1 receptors stimulates fatty acid synthesis and contributes to diet-induced obesity," The Journal of Clinical Investigation, May 2005, pp. 1298-1305, vol. 115, No. 5.
Pacher et al., "Modulating the endocannabinoid system in human health and disease: successes and failures," FEBS J., May 2013, pp. 1918-1943, vol. 280, No. 9.
Parmiani et al., "Uniquie Human Tumor Antigens: Immunobiology and Use in Clinical Trials," The Journal of Immunology, 2007, pp. 1975-1979, vol. 178.
Patsenker et al., "Cannabinoid Receptor Type 1 Modulates Alcohol-Induced Liber Fibrosis," Mol. Med., Dec. 2011, pp. 1285-1294, vol. 17, No. 11-12.
Peirersz et al., "The use of monoclonal antibody conjugates for the diagnosis and treatment of cancer," Immunology and Cell Biology, 1987, pp. 111-125, vol. 65 (Pt. 2).
Pi-Sunyer et al., "Improvement of Metabolic Parameterse with Rionabant Beyond the Effect Attributble to Weight Loss Alone: Pooled 1-Year Data from the RIO (Rimonabant in Obesity and Related Metabolic Disorders) Program," J. Am. Coll. Cardio., 2006, p. 362A.
Ahn, et al., "Dual Role of the Second Extracellular Loop of the Cannabinoid Receptor 1: Ligand Binding and Receptor Localization", Molecular Pharmacology, 76:833-842 (2009).
Bertalovitz, et al., "Ligand Binding Sensitivity of the Extracellular Loop Two of the Cannabinoid Receptor 1", Drug Dev. Res., 71:404-411 (2010).
Brennan, et al., "Safety and immunotoxicity assessment of immunomodulatory monoclonal antibodies", Landes Bioscience, 3:233-255 (2010).

Di Marzo, Vincenzo. "CB1 Receptor Antagonism: Biological Basis for Metabolic Effects", Drug Discovery Today, 13:1026-1041 (2008).
Chinn, Paul, U.S. Appl. No. 09/259,338, filed Mar. 1, 1999, 48 pages.
Hutchings, et al., "Therapeutic antibodies directed at G protein-coupled receptors", mAbs, 2:594-606 (2010).
Klarenbeek, et al., "Targeting chemokines and chemokine receptors with antibodies", Drug Discover Today: Technologies, 9:e237-e244 (2012).
Leu, et al., "GPCR Somatostatin Receicptor Extracellular Loop 2 Is a Key Ectodomain for Making Subtype-Selective Antibodies With Agonist-Like Activities in the Pancreatic Neurodocrine Tumor BON Cell Line", Pancreas, 39:1155-1166 (2010).
Marcu, et al., "Novel Insights into CB1 Cannabinoid Receptor Signaling: A Key Interaction Identified between the Extracellular-3 Loop and Transmembrane Helix 2", The Journal of Pharmacology and Experimental Therapeutics, 345:189-197 (2013).
Padlan et al., "Identification of Specificity-Determining Residues in Antibodies", The FASEB Journal, vol. 9, pp. 133-139, Jan. 1995.
Peng, et al., "Molecular basis for the antagonistic activity of an anti-CXCR4 antibody", mAbs, 8:163-175 (2016).
Phumyen, et al., "Improved Binding Activity of Antibodies Against Major Histocompatibility Complex Class I Chain-Related Gene A by Phage Display Technology for Cancer-Targeted Therapy", Journal of Biomedicine and Biotechnology, vol. 2012, Article ID 597647, 8 pages, Jul. 20, 2012.
Pluckthun et al., "New protein engineering approaches to multivalent and bispecific antibody fragments," Immunotechnology, 1997, pp. 83-105, vol. 3.
Pryce et al., "Control of Spasticity in a Multiple Sclerosis Model is mediated by CB1, not CB2, Cannabinoid Receptors," British Journal of Pharmacology, 2007, pp. 519-525, vol. 150.
Rader et al., "A phage display approach for rapid antibody humanization: Designed combinatorial V Gene libraries," Proc. Natl. Acad. Sci., Jul. 1998, pp. 8910-8915, vol. 95.
Rother et al., "Discovery and development of the complement inhibitor eculizumab for the treatment of paroxysmal nocturnal hemoglobinura," Nature Biotechnology, Nov. 2007, pp. 1256-1264, vol. 25, No. 11.
Rudikoff et al., "Single Amino Substitution Altering Antigen-Binding Specificity", Proc. Natl. Acad. Sci., vol. 79, pp. 1979-1983, Mar. 1982.
Salio, et al. "CB1-cannabinoid and μ-opioid receptor co-localization on postsynaptic target in the rat dorsal horn", NeuroReport, vol. 12:3689-3692 (2001).
Sanz, et al., "Antibodies and Gene Therapy: Teaching Old 'Magic Bullets' New Tricks", Trends in Immunology, 25 (2):85-91 (2004).
Sensi et al., "Unique Tumor Antigens: Evidence for Immune Control of Genome Integrity and Immunogenic Targets for T Cell-Mediated Patient-Specific Immunotherapy," Clin. Cancer Res., Sep. 1, 2006, pp. 5023-5032, vol. 12, No. 17.
Shang et al., "Antixenografl tumor activity of a humanized anti-insulin-like growth factor-1 receptor monoclonal antibody is associated with decreased AKT activation and glucose uptake," Mol. Cancer Ther., Sep. 2008, pp. 2599-2608, vol. 7, No. 9.
Short et al., "Complementary Combining Site Contact Residue Mutations of the Anti-digoxin Fab 26-10 Permit High Affinity Wild-type Binding," The Journal of Biological Chemistry, May 10, 2002, pp. 16365-16370, vol. 277, No. 19.
Smith et al., "Non-alcoholic fatty liver disease," Crit. Rev. Clin. Lab Sci., 2011, pp. 97-113, vol. 48, No. 3.
Stein et al., "Characterization of a new Humanized Anti-CD20 Monoclonal Antibody, IMMU-106, and Its Use in Combination with the Humanized Anti-CD22 Antibody, Epratuzumab, for the Therapy of Non-Hodgkin's Lymphoma," Clinical Cancer Research, Apr. 15, 2004, pp. 2868-2878, vol. 10.
Suresh et al., "Bispecific Monoclonal Antibodies from Hybrid Hybridomas," Methods in Enzymology, 1986, pp. 210-228, vol. 121.
Tam, et al. "Peripheral Cannabinoid-1 Receptor Inverse Agonism Reduces Obesity by Reversing Leptin Resistance", Cell Metabolism, 16:167-179 (2012).

(56) References Cited

OTHER PUBLICATIONS

Tam, et al., "Peripheral CB1 cannabinoid receptor blockade improves cardiometabolic risk in mouse models of obesity," J Clin Invest. 120(8):2953-66 (2010).

Tamura et al., "Structural Correlates of an Anticarcinoma Antibody: Identification of Specificity-Determining Residues (SDRs) and Development of a Minimally Immunogenic Antibody Variant by Retention of SDRs Only", J Immunol 2000; 164:1432-1441.

Takano et al., "Low Brain CB1 Receptor Occupancy by a Second Generation CB1 Receptor Antagonist TM38837 in Comparison With Rimonabant in Nonhuman Primates: A PET Study," Synapse, 2004, pp. 89-97, vol. 68.

Talwar et al., "Cannabinoid 1 (CB1) Receptor—Pharmacology, Role in Pain and Recent Developments in Emergin CB1 Agonists," CNS Neurological Disorders—Drug Targets, 2011, pp. 536-544, vol. 10.

Teixeira-Clerc et al., "CB1 cannabinoid receptor antagonism: a new strategy for the treatment of liver fibrosis," Nature Medicine, Jun. 2006, pp. 671-676, vol. 12, No. 6.

Thompson et al., "Affinity Maturation of a High-affinity Human Monoclonal Antibody Against the Third Hypervariable Loop of Human Immunodeficiency Virus: Use of Phage Display to Improve Affinity and Broaden Strain Reactivity," J. Mol. Biol., 1996, pp. 77-88, vol. 256.

Tobin et al., "Combination immunotherapy with anti-CD20 and anti-HLA-DR monoclonal antibodies induces synergistic anti-lymphoma effects in human lymphoma cell lines," Leukemia & Lymphoma, May 2007, pp. 944-956, vol. 48, No. 5.

Todorovska et al., "Design and application of diabodies, triabodies and tetrabodies for cancer targeting," Journal of Immunological Methods, 2001, pp. 47-66, vol. 248.

Traunecker et al., "Bispecific single chain molecules (Janusins) target cytotoxic lymphocytes on HIV infected cells," The EMBO Journal, 1991, pp. 3655-3659, vol. 10, No. 12.

U.S. Appl. No. 61/839,458, filed Jun. 26, 2013, entitled CB1 Receptor Antigen-Binding Proteins and Uses Thereof.

Vander Poorten et al., "Hepatitis C Virus Induces the Cannabinoid Receptor 1," PlosOne, e12841, Sep. 2010, pp. 1-10, vol. 5, No. 9.

Vaughan et al., "Human antibodies by design," Nature Biotechnology, Jun. 1998, pp. 535-539, vol. 16.

Votsmeier et al., "Femtomolar Fab Binding Affinities to a Protein Target by Alternative CDR Residue Co-optimization Strategies without Phage or Cell Surface Display", mAbs 4:3, Landes Bioscience, pp. 341-348, May/Jun. 2012.

Wagner et al., "Cannabinoid type 1 receptor mediates depot-specific effects on differentiation, inflammation and oxidative metabolism in inguinal and epididymal white adipocytes," Nutr Diabetes. 5;1:e16 (2011).

Wan et al., "Fat or Fiction: Origins Matter," Cell Metabolism, Jun. 3, 2014, pp. 900-901, vol. 19.

Webb, et al., "Opportunities for Functional Selectivity in GPCR Antibodies", Biochem Pharmacol., 15:147-152 (2013).

Wei et al., "The peripheral cannabinoid receptor 1 antagonist VD60 efficiently inhibits carbon tetrachloride-intoxicated hepatic fibrosis progression," Experimental Biology and Medicine, 2014, pp. 183-192, vol. 239.

Winter et al., "Making Antibodies by Phage Display Technology," Annu. Rev. Immunol., 1994, pp. 433-455, vol. 12.

Woolley, et al., "The role of ECL2 in CGRP receptor activation: a combined modelling and experimental approach", JR Soc Interface 10:1-11 (2013).

Yang et al., "CDR Walking Mutagenesis for the Affinity Maturation of a Potent Human Anti-HIV-1 Antibody into the Piocomolar Range," J. Mol. Bioi., 1995, pp. 392-403, vol. 254.

International Search Report and Written Opinion, prepared by the European Patent Office, dated Sep. 24, 2015, issued in connection with International Application No. PCT/US2015/023108, 20 pages.

Lim, et al., "Cannabinoid receptor 1 mediates high glucose-induced apoptosis via endoplasmic reticulum stress in primary cultured rat mesangial cells", Am J Physiol Renal Physiol., 301 :F179-F188 (2011).

McPartland et al., "Meta-analysis of cannabinoid ligand binding affinity and receptor distribution: interspecies differences," Br J Pharmacol. Nov. 2007; 152(5): 583-593.

Morozov, et al., "Antibodies to cannabinoid type 1 receptor co-react with stomatin-like protein 2 in mouse brain mitochondria", European Journal of Neuroscience, 38:2341-2348 (2013).

Ohno S. et al., "Antigen-binding specificities of antibodies are primarily determined by sevenresidues of VH," Proc Nati. Acad. Sci., 1985, V.82, pp. 2945-2949 (Abstract)).

Pakula A.A. et al., "Genetic analysis of protein stability and function", Annu. Rev. Genet., 23:298-310 (1989).

Ramamoorthi et al., So you Need a Protein—A Guide to the Production of Recombinant Proteins, The Open Veterinary Science Journal, 2009, 3, 28-34.

Roitt, Immunology, Moscow, Mir, 592:110-111 (2001).

Singer M. et al., "Genes and Genomes," Moscow, Mir, 1998, v 1, pp. 63-64.

Sundberg J., "Structural Basis of Antibody-Antigen Interactions," Methods in Molecular Biology, Epitope Mapping Protocols, 2009, v.524, ch.2, pp. 23-36 (2. Binding Energetics of Antigen Recognition).

Berg et al, "Making Sense of Pharmacology: Inverse Agonismand Functional Selectivity," Int J Neuropsychopharmacol 21(10):962-977 (2018).

Deleve, et al., "Prevention of Hepatic Fibrosis in a Murine Model of Metabolic Syndrome with Nonalcoholic Steatohepatitis", The American journal of Pathology, 173:994-1001 (2008).

Gonzales, et al., "Minimizing the Immunogenicity of Antibodies for Clinical Application". Tumour Biol. Jan.-Feb. 2005;26(1):31-43.

Meng et al., "Astrocytic expression of cannabinoid type 1 receptor in rat and human sclerotic hippocampi," Int J Clin Exp Pathol. 2014; 7(6): 2825-2837.

Russo, S., and W. F. De Azevedo. "Advances in the Understanding of the Cannabinoid Receptor 1-Focusing on the Inverse Agonists Interactions." Current medicinal chemistry, 25, 1-12 (2018).

Wu, H., et al: "Humanization of a Murine Monoclonal Antibody by Simultaneous Optimization of Framework and CDR Residues". J Mol. Biol. (1999) 294, 151-162.

International Search Report and Written Opinion, prepared by the European Patent Office, dated Feb. 21, 2017, issued in connection with International Application No. PCT/US16/53927, 3 pages.

International Preliminary Reporton Patentability and Written Opinion, prepared by the European Patent Office, dated Apr. 3, 2018, issued in connection with International Application No. PCT/US16/53927, 3 pages.

PCT Application No. PCT/CN2014/081797 filed on Jul. 8, 2014, entitled "Antibodies that Bind Human Cannabinoid 1 (CB1) Receptor".

Marquart, et al., Inactivation of the Cannabinoid Receptor CB1 Prevents Leukocyte Infiltration and Experimental Fibrosis, Arthritis & Rheumatism 62:3467-3476 (2010).

Dol-Gleizes et al., "Rimonabant, a Selective Cannabinoid CB1 Receptor Antagonist, Inhibits Atherosclerosis in LDL Receptor-Deficient Mice," Arterioscler Thromb Vasc Biol 29(1):12-8 (2009).

Jakubke H.-D. et al. Aminokisloty, peptidy, belki // M: transl. from German—M.: Mir, 1985.-456 p., Illustrations; pp. 356-363.

Khoury, et al., "Allosteric and biased G protein-coupled receptor signaling regulation: potentials for new therapeutics", Frontiers in Endocrinology, 5:1-8 (2014).

Lecru, et al., "Cannabinoid receptor 1 is a major mediator of renal fibrosis", Kidney International, 88:72-84 (2015).

Liu, et al., "Allostery: An Overview of Its History, Concepts, Methods, and Applications", PLoS Comput, 2;12(6), 1-5 (2016).

Tam et al., "The emerging role of the endocannabinoid system in the pathogenesis and treatment of kidney diseases," J Basic Clin Physiol Pharmacol 27(3):267-76 (2016).

Scheen, et al., "Use of cannabinoid CB1 receptor antagonists for the treatment of metabolic disorders", Best Practice & Research Clinical Endocrinology & Metabolism 23:103-116 (2009).

(56) References Cited

OTHER PUBLICATIONS

Shim, et al., "Understanding functional Residues of Cannabinoid CB1 Receptor for Drug Discovery", Curr Top Med Chem. 10(8):779-798 (2010).

* cited by examiner

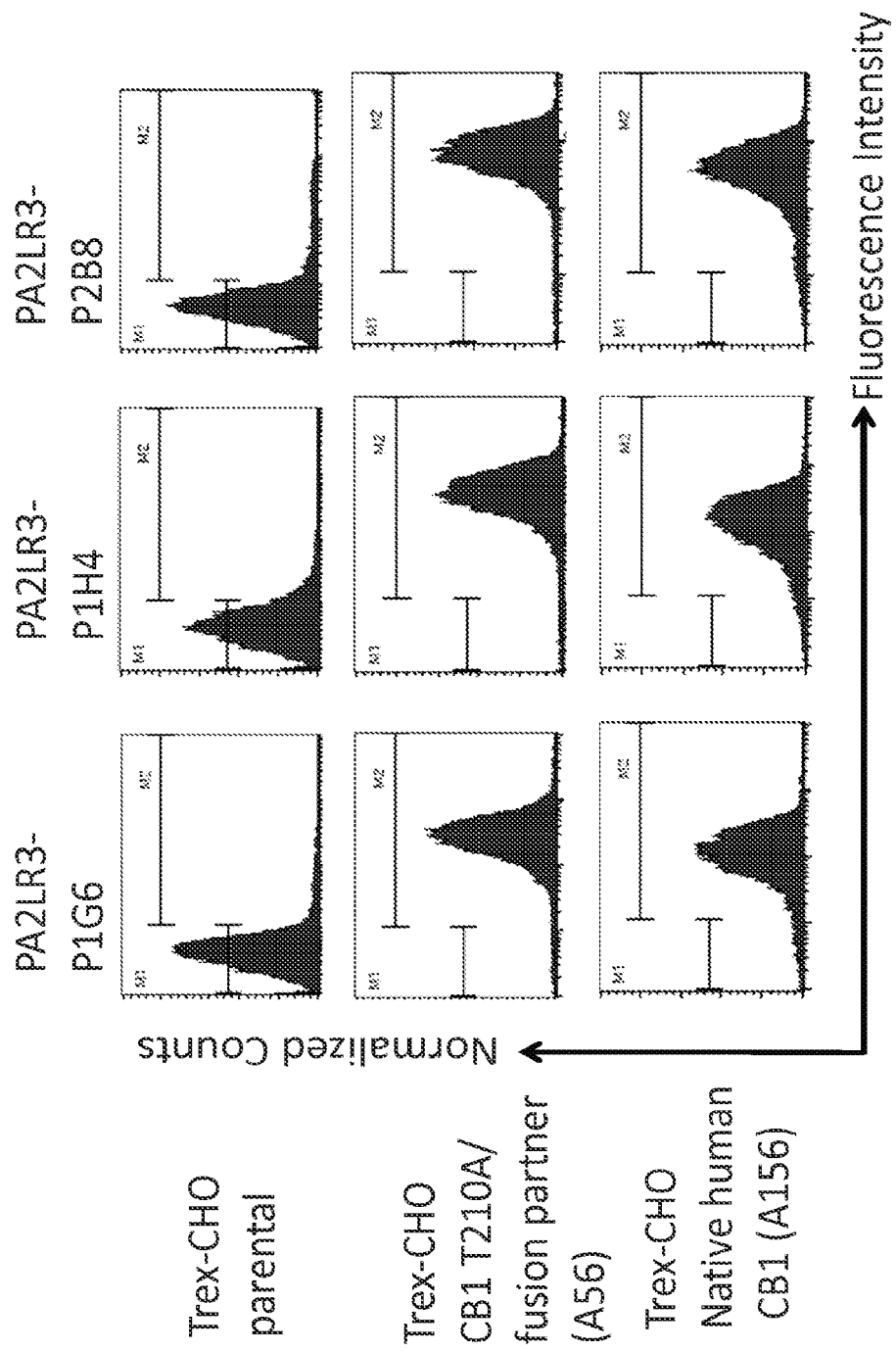

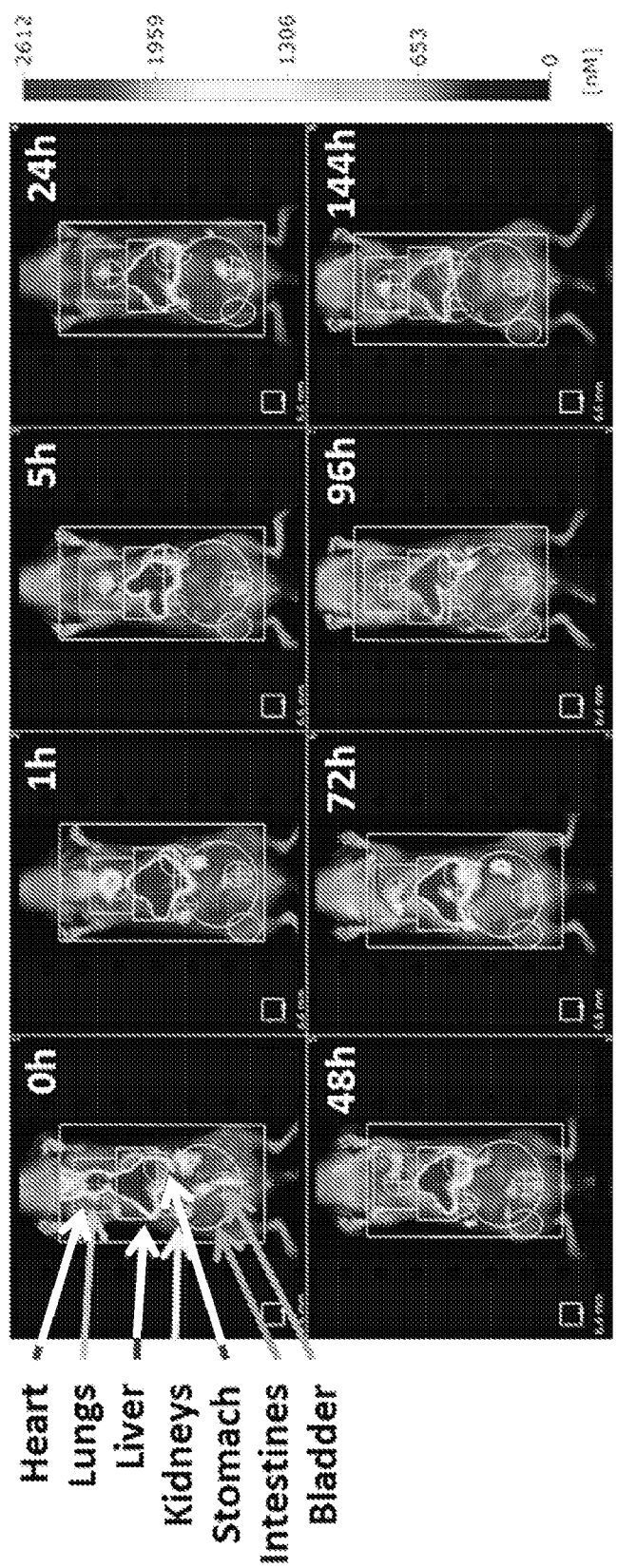
FIG. 13A.1

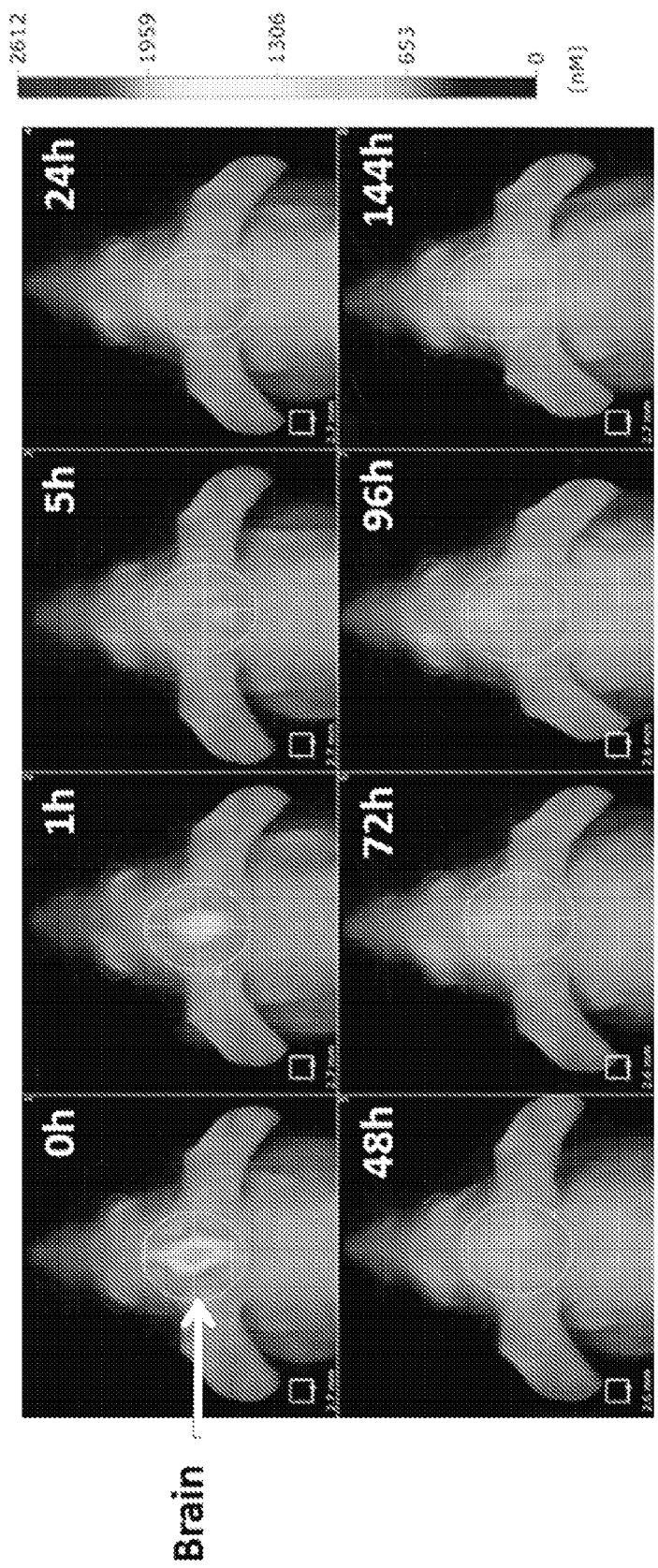
FIG. 13A.2

ANTIBODIES THAT BIND HUMAN CANNABINOID 1 (CB1) RECEPTOR

REFERENCE TO EARLIER APPLICATION

This application is a National-Stage of International Application No. PCT/US2016/053927, filed Sep. 27, 2016, which claims the benefit of U.S. Provisional Patent Application Ser. No. 62/235,194, filed Sep. 30, 2015, each of which are incorporated by reference herein in their entirety.

FIELD OF THE INVENTION

The present invention relates to antibodies and antigen-binding fragments thereof that bind to cannabinoid receptor 1 (CB1) receptor, and methods of using such antibodies and antigen-binding fragments.

DESCRIPTION OF THE TEXT FILE SUBMITTED ELECTRONICALLY

The contents of the text file submitted electronically herewith are incorporated herein by reference in their entirety: A computer readable format copy of the Sequence Listing (filename: 15-343-PRO_Seq_List_2015-09-30_ST25, date recorded: Sep. 30, 2015, file size 803 KB).

BACKGROUND

Cannabinoid 1 (CB1) receptor is a member of the G protein-coupled receptor (GPCR) superfamily. The CB1 receptor is expressed in the central nervous system (CNS), lungs, liver, adipose tissue and kidneys, and has been implicated in many human diseases including obesity, diabetes, fibrosis, liver diseases, cardiovascular disease, cancer, pain, MS spasticity, and glaucoma, among others. More specifically, CB1 receptor has been shown to exhibit detrimental activity in, for example, obesity, diabetes, fibrosis, liver diseases, cardiovascular disease and cancer; and has been shown to exhibit beneficial activity in pain, MS spasticity and glaucoma, among others.

There is a need in the art for new CB1 receptor antagonists and agonists for therapeutic purposes as well as selective binders for diagnostic/imaging purposes. In particular, a CB1 receptor-targeting compound that lacks the capacity for CNS penetration would be desirable to reduce potential CNS-mediated side effects of CB1 receptor modulation, highlighted by the psychiatric adverse events associated with the CB1 inverse agonist rimonabant.

SUMMARY OF THE INVENTION

In one aspect, the present invention provides antibodies and antigen-binding fragments thereof that bind to cannabinoid 1 receptor (also referred to herein as "CB1 receptor" or "CB1"). In some embodiments, the CB1 receptor is a human CB1 receptor. In some embodiments, the antibody or fragment thereof recognizes one or more extracellular epitopes on the CB1 receptor. In some embodiments, the CB1 receptor binding antibodies and fragments thereof provided herein are functional antibodies or antigen binding fragments thereof. In some embodiments, the CB1 receptor binding antibodies or fragments thereof inhibit or increase CB1 receptor signaling activity. In some embodiments, the CB1 receptor binding antibodies or fragments thereof are antagonistic antibodies, in that they inhibit CB1 receptor signaling activity. In some embodiments, the CB1 receptor binding antibodies or fragments thereof are agonistic antibodies, in that they enhance CB1 receptor signaling activity. In some embodiments, the CB1 receptor binding antibodies or fragments thereof are modulators of CB1 receptor signaling activity or are allosteric modulators of CB1 receptor signaling activity. In some embodiments the CB1 receptor binding antibodies or fragments thereof are selective binders without agonist or antagonist activity. In some embodiments, the CB1 receptor binding antibodies or fragments thereof are selective binders without agonist or antagonist activity that are useful for diagnostic and/or imaging purposes.

The isolated antibodies or antigen binding fragments thereof, in some embodiments, are at least as potent as small molecule CB1 receptor modulators such as, for example, AM6545, AM251, or rimonabant. In some embodiments, the antibodies or fragments thereof have CB1 receptor inhibiting or activating activity that is at least 2 fold, at least 3 fold, at least 4 fold, at least 5 fold, at least 10 fold, or at least 20 fold more potent relative to the small molecules AM6545, AM251, or rimonabant. In some embodiments, the isolated antibodies or antigen binding fragments thereof inhibit CB1 receptor agonist-mediated signal transduction. In some embodiments, the inhibition of CB1 receptor agonist-mediated signal transduction is measured by determining intracellular cAMP levels and/or downstream ERK phosphorylation.

In some embodiments, the isolated antibodies and antigen-binding fragments thereof have the advantage of reduced or absent brain penetration. In some embodiments, the brain penetration of the isolated antibodies and antigen-binding fragments thereof exhibit reduced brain penetration relative to small molecule CB1 receptor agonists or antagonists (e.g., AM6545, AM251, or rimonabant). In some embodiments, the CB1 receptor binding antibodies and fragments thereof provided herein provide a therapeutic benefit with reduced central nervous system side effects relative to a small molecule CB1 receptor agonist or antagonist. CNS side effects associated with small molecule CB1 receptor antagonist rimonabant include anxiety, depression, agitation, eating disorders, irritability, aggression, and insomnia (Moreira, 2009, Rev Bras Psiquiatr., 31(2):145-53).

In some embodiments, the isolated antibodies and antigen-binding fragments thereof provided herein are generated from hybridoma cell lines. In other embodiments, the isolated antibodies and antigen-binding fragments thereof provided herein are generated from phage display libraries.

In some embodiments, the isolated antibodies and antigen-binding fragments thereof provided herein have an affinity for native human CB1 receptor that is at least nM range. For example, in some embodiments, the affinity for CB1 receptor is about 1 µM or less, or about 750 nM or less, or about 500 nM or less, or about 250 nM or less, or about 100 nM or less, or about 75 nM or less, or about 50 nM or less, or about 25 nM or less, or about 10 nM or less, or about 1 nM or less. In other embodiments, the isolated antibodies and antigen-binding fragments disclosed herein have an affinity for CB1 receptor of about 15 nM or less. In some embodiments, the isolated antibodies and antigen-binding fragments thereof have an affinity for human CB1 receptor that is from about 0.01 nM to about 500 nM, about 0.02 nM to about 250 nM, about 0.02 to about 200 nM, about 0.05 to about 100 nM, about 0.05 to about 50 nM.

The isolated antibodies and antigen binding fragments thereof of the present invention may be derived from any species including, but not limited to, mouse, rat, rabbit, hamster, guinea pig, primate, llama or human. In some embodiments, the isolated antibodies and antigen binding fragments thereof are murine antibodies. In other embodiments, the isolated antibodies and antigen binding fragments thereof are chimeric antibodies. In still other embodiments, the isolated antibodies and antigen binding fragments thereof are humanized antibodies. In some embodiments, the isolated antibodies and antigen binding fragments thereof are fully human antibodies.

In one embodiment, the isolated antibodies and antigen binding fragments thereof are humanized or chimeric P1C4 antibodies, as described herein. In one embodiment, the humanized P1C4 antibodies are selected from the group consisting of P1C4-H0, P1C4-H2, and P1C4-H4, as described herein. In one embodiment, the isolated antibodies and antigen binding fragments thereof comprise Fc modifications that result in reduced, impaired, or eliminated antibody effector function. In a further embodiment, the isolated antibodies and antigen binding fragments thereof are selected from the group consisting of P1C4-H0-IgG2-4 Hybrid, P1C4-H0-IgG2A330S/P331S, P1C4-H0-IgG4S228P, P1C4-H2-IgG2-4 Hybrid, P1C4-H2-IgG2A330S/P331S, P1C4-H2-IgG4S228P, P1C4-H4-IgG2-4 Hybrid, P1C4-H4-IgG2A330S/P331S, P1C4-H4-IgG4S228P.

In one embodiment, the isolated antibody or antigen binding fragment thereof comprises a heavy chain variable region comprising a nucleic acid sequence selected from the group consisting of SEQ ID NOs. 1, 9, 17, 25, 33, 41, 49, and 57. In another embodiment, the isolated antibody or antigen binding fragment thereof comprises a heavy chain variable region comprising an amino acid sequence selected from the group consisting of SEQ ID NOs. 2, 10, 18, 26, 34, 42, 50, and 58. In another embodiment, the isolated antibody or antigen binding fragment thereof comprises a heavy chain constant region comprising a nucleic acid sequence selected from the group consisting of SEQ ID NOs. 3, 11, 19, 27, 35, 43, 51, and 59. In another embodiment, the isolated antibody or antigen binding fragment thereof comprises a heavy chain constant region comprising an amino acid sequence selected from the group consisting of SEQ ID NOs. 4, 12, 20, 28, 36, 44, 52, and 60. In another embodiment, the isolated antibody or antigen binding fragment thereof comprises a light chain variable region comprising a nucleic acid sequence selected from the group consisting of SEQ ID NOs 5, 13, 21, 29, 37, 45, 53, and 61. In another embodiment, the isolated antibody or antigen binding fragment thereof comprises a light chain variable region comprising an amino acid sequence selected from the group consisting of SEQ ID NOs. 6, 14, 22, 30, 38, 46, 54, and 62. In another embodiment, the isolated antibody or antigen binding fragment thereof comprises a light chain constant region comprising an amino acid sequence selected from the group consisting of SEQ ID NOs. 7, 15, 23, 31, 39, 47, 55, and 63. In another embodiment, the isolated antibody or antigen binding fragment thereof comprises a light chain constant region comprising an amino acid sequence selected from the group consisting of SEQ ID NOs. 8, 16, 24, 32, 40, 48, 56, and 64.

In one embodiment, the isolated antibody or antigen binding fragment thereof comprises a heavy chain variable region comprising a nucleic acid sequence according to SEQ ID NO: 1; a heavy chain constant region comprising a nucleic acid sequence according to SEQ ID NO: 3; a light chain variable region comprising a nucleic acid sequence according to SEQ ID NO: 5; and a light chain constant region comprising a nucleic acid sequence according to SEQ ID NO: 7.

In one embodiment, the isolated antibody or antigen binding fragment thereof comprises a heavy chain variable region comprising an amino acid sequence according to SEQ ID NO: 2; a heavy chain constant region comprising an amino acid sequence according to SEQ ID NO: 4; a light chain variable region comprising an amino acid sequence according to SEQ ID NO: 6; and a light chain constant region comprising an amino acid sequence according to SEQ ID NO: 8.

In one embodiment, the isolated antibody or antigen binding fragment thereof comprises a heavy chain variable region comprising a nucleic acid sequence according to SEQ ID NO: 9; a heavy chain constant region comprising a nucleic acid sequence according to SEQ ID NO: 11; a light chain variable region comprising a nucleic acid sequence according to SEQ ID NO: 13; and a light chain constant region comprising a nucleic acid sequence according to SEQ ID NO: 15.

In one embodiment, the isolated antibody or antigen binding fragment thereof comprises a heavy chain variable region comprising an amino acid sequence according to SEQ ID NO: 10; a heavy chain constant region comprising an amino acid sequence according to SEQ ID NO: 12; a light chain variable region comprising an amino acid sequence according to SEQ ID NO: 14; and a light chain constant region comprising an amino acid sequence according to SEQ ID NO: 16.

In one embodiment, the isolated antibody or antigen binding fragment thereof comprises a heavy chain variable region comprising a nucleic acid sequence according to SEQ ID NO: 17; a heavy chain constant region comprising a nucleic acid sequence according to SEQ ID NO: 19; a light chain variable region comprising a nucleic acid sequence according to SEQ ID NO: 21; and a light chain constant region comprising a nucleic acid sequence according to SEQ ID NO: 23.

In one embodiment, the isolated antibody or antigen binding fragment thereof comprises a heavy chain variable region comprising an amino acid sequence according to SEQ ID NO: 18; a heavy chain constant region comprising an amino acid sequence according to SEQ ID NO: 20; a light chain variable region comprising an amino acid sequence according to SEQ ID NO: 22; and a light chain constant region comprising an amino acid sequence according to SEQ ID NO: 24.

In one embodiment, the isolated antibody or antigen binding fragment thereof comprises a heavy chain variable region comprising a nucleic acid sequence according to SEQ ID NO: 25; a heavy chain constant region comprising a nucleic acid sequence according to SEQ ID NO: 27; a light chain variable region comprising a nucleic acid sequence according to SEQ ID NO: 29; and a light chain constant region comprising a nucleic acid sequence according to SEQ ID NO: 31.

In one embodiment, the isolated antibody or antigen binding fragment thereof comprises a heavy chain variable region comprising an amino acid sequence according to SEQ ID NO: 26; a heavy chain constant region comprising an amino acid sequence according to SEQ ID NO: 28; a light chain variable region comprising an amino acid sequence according to SEQ ID NO: 30; and a light chain constant region comprising an amino acid sequence according to SEQ ID NO: 32.

In one embodiment, the isolated antibody or antigen binding fragment thereof comprises a heavy chain variable region comprising a nucleic acid sequence according to SEQ ID NO: 33; a heavy chain constant region comprising a nucleic acid sequence according to SEQ ID NO: 35; a light chain variable region comprising a nucleic acid sequence according to SEQ ID NO: 37; and a light chain constant region comprising a nucleic acid sequence according to SEQ ID NO: 39.

In one embodiment, the isolated antibody or antigen binding fragment thereof comprises a heavy chain variable region comprising an amino acid sequence according to SEQ ID NO: 34; a heavy chain constant region comprising an amino acid sequence according to SEQ ID NO: 36; a light chain variable region comprising an amino acid sequence according to SEQ ID NO: 38; and a light chain constant region comprising an amino acid sequence according to SEQ ID NO: 40.

In one embodiment, the isolated antibody or antigen binding fragment thereof comprises a heavy chain variable region comprising a nucleic acid sequence according to SEQ ID NO: 41; a heavy chain constant region comprising a nucleic acid sequence according to SEQ ID NO: 43; a light chain variable region comprising a nucleic acid sequence according to SEQ ID NO: 45; and a light chain constant region comprising a nucleic acid sequence according to SEQ ID NO: 47.

In one embodiment, the isolated antibody or antigen binding fragment thereof comprises a heavy chain variable region comprising an amino acid sequence according to SEQ ID NO: 42; a heavy chain constant region comprising an amino acid sequence according to SEQ ID NO: 44; a light chain variable region comprising an amino acid sequence according to SEQ ID NO: 46; and a light chain constant region comprising an amino acid sequence according to SEQ ID NO: 48.

In one embodiment, the isolated antibody or antigen binding fragment thereof comprises a heavy chain variable region comprising a nucleic acid sequence according to SEQ ID NO: 49; a heavy chain constant region comprising a nucleic acid sequence according to SEQ ID NO: 51; a light chain variable region comprising a nucleic acid sequence according to SEQ ID NO: 53; and a light chain constant region comprising a nucleic acid sequence according to SEQ ID NO: 55.

In one embodiment, the isolated antibody or antigen binding fragment thereof comprises a heavy chain variable region comprising an amino acid sequence according to SEQ ID NO: 50; a heavy chain constant region comprising an amino acid sequence according to SEQ ID NO: 52; a light chain variable region comprising an amino acid sequence according to SEQ ID NO: 54; and a light chain constant region comprising an amino acid sequence according to SEQ ID NO: 56.

In one embodiment, the isolated antibody or antigen binding fragment thereof comprises a heavy chain variable region comprising a nucleic acid sequence according to SEQ ID NO: 57; a heavy chain constant region comprising a nucleic acid sequence according to SEQ ID NO: 59; a light chain variable region comprising a nucleic acid sequence according to SEQ ID NO: 61; and a light chain constant region comprising a nucleic acid sequence according to SEQ ID NO: 63.

In one embodiment, the isolated antibody or antigen binding fragment thereof comprises a heavy chain variable region comprising an amino acid sequence according to SEQ ID NO: 58; a heavy chain constant region comprising an amino acid sequence according to SEQ ID NO: 60; a light chain variable region comprising an amino acid sequence according to SEQ ID NO: 62; and a light chain constant region comprising an amino acid sequence according to SEQ ID NO: 64.

In one embodiment, the invention provides an isolated antibody or fragment thereof that comprises a nucleic acid sequence or an amino acid sequence that is at least 65%, at least 70%, at least 75%, at least 80%, at least 85%, at least 90%, at least 95%, or at least 99% identical to an amino acid sequence selected from the group consisting of SEQ ID NOs. 1-351.

In one embodiment, the isolated antibody or antigen binding fragment thereof comprises heavy chain complementary determining regions (CDRs) independently selected from the CDRs present in the heavy chain variable regions according to SEQ ID NOs: 2, 10, 18, and 26. In another embodiment, the isolated antibody or antigen binding fragment thereof comprises light chain CDRs independently selected from the CDRs present in the light chain variable regions according to SEQ ID NOs: 6, 14, 22, and 30.

In one embodiment, the isolated antibody or antigen binding fragment thereof is a humanized antibody comprising heavy chain complementary determining regions (CDRs) independently selected from the CDRs present in the heavy chain variable regions according to SEQ ID NOs: 2, 10, 18, and 26. In another embodiment, the isolated antibody or antigen binding fragment thereof is a humanized antibody comprising light chain complementary determining regions (CDRs) independently selected from the CDRs present in the light chain variable regions according to SEQ ID NOs: 6, 14, 22, and 30.

In one embodiment, the heavy chain variable region comprises, consists essentially of, or consists of an amino acid sequence selected from the group consisting of SEQ ID NOs: 339-341. In one embodiment, the isolated antibody or antigen binding fragment thereof comprises a heavy chain variable region amino acid sequence that is at least 65%, at least 70%, at least 75%, at least 80%, at least 85%, at least 90%, at least 95%, at least 96%, at least 97%, at least 98% or at least 99% identical to an amino acid sequence selected from the group consisting of SEQ ID NOs: 339-341. In a further embodiment, the heavy chain variable region comprises, consists essentially of, or consists of an amino acid sequence selected from the group consisting of SEQ ID NOs: 339-341.

In another embodiment, the isolated antibody or antigen binding fragment thereof comprises a heavy chain amino acid sequence that is least 65%, at least 70%, at least 75%, at least 80%, at least 85%, at least 90%, at least 95%, at least 96%, at least 97%, at least 98% or at least 99% identical to an amino acid sequence selected from the group consisting of SEQ ID NOs: 343-351. In a further embodiment, the heavy chain comprises, consists essentially of, or consists of an amino acid sequence selected from the group consisting of SEQ ID NOs:343-351.

In another embodiment, the isolated antibody or antigen binding fragment thereof comprises a light chain variable region amino acid sequence that is least 65%, at least 70%, at least 75%, at least 80%, at least 85%, at least 90%, at least 95%, at least 96%, at least 97%, at least 98% or at least 99% identical to an amino acid sequence according to SEQ ID NO: 337. In a further embodiment, the heavy chain variable region comprises, consists essentially of, or consists of an amino acid sequence according to SEQ ID NO: 337. In another embodiment, the isolated antibody or antigen binding fragment thereof comprises a light chain amino acid sequence that is least 65%, at least 70%, at least 75%, at least 80%, at least 85%, at least 90%, at least 95%, at least 96%, at least 97%, at least 98% or at least 99% identical to an amino acid sequence according to SEQ ID NO: 338. In a further embodiment, the light chain comprises, consists essentially of, or consists of an amino acid sequence according to SEQ ID NO: 338.

In one embodiment, the invention provides a humanized isolated antibody or antigen binding fragment thereof that binds CB1. In a further embodiment, the isolated antibody or antigen binding fragment thereof comprises a light chain variable region according to SEQ ID NO: 337 and a heavy chain variable region according to SEQ ID NO: 339. In another embodiment, the isolated antibody or antigen binding fragment thereof comprises a light chain variable region according to SEQ ID NO: 337 and a heavy chain variable region according to SEQ ID NO: 340. In another embodiment, the isolated antibody or antigen binding fragment thereof comprises a light chain variable region according to SEQ ID NO: 337 and a heavy chain variable region according to SEQ ID NO: 341. In another embodiment, the isolated antibody or antigen binding fragment thereof comprises a full light chain according to SEQ ID NO: 338 and a full heavy chain according to a sequence selected from the group consisting of SEQ ID NOs: 343-351.

In other embodiments, the isolated antibody or antigen binding fragment thereof comprises a light chain sequence according to SEQ ID NO: 829, 830, 831, or 832. In some embodiments, the isolated antibody or antigen binding fragments comprise a light chain sequence according to SEQ ID NO: 829, 830, 831, or 832, and a heavy chain sequence according to SEQ ID NO: 437.

In one embodiment, the isolated antibody or fragment thereof comprises a heavy chain CDR1 sequence having at least 80%, at least 85%, at least 90%, at least 95% at least 96%, at least 97%, at least 98%, or at least 99% homology to the amino acid sequence of SEQ ID NO: 352 (YYWMN). In another embodiment, the isolated antibody or fragment thereof comprises a heavy chain CDR2 sequence having at least 80%, at least 85%, at least 90%, at least 95% at least 96%, at least 97%, at least 98%, or at least 99% homology to the amino acid sequence of SEQ ID NO: 353 (QIYPGDGETKY). In another embodiment, the isolated antibody or fragment thereof comprises a heavy chain CDR3 sequence having at least 80%, at least 85%, at least 90%, at least 95% at least 96%, at least 97%, at least 98%, or at least 99% homology to the amino acid sequence of SEQ ID NO: 354 (SHGNYLPY). In another embodiment, the isolated antibody or fragment thereof comprises a light chain CDR1 sequence having at least 80%, at least 85%, at least 90%, at least 95% at least 96%, at least 97%, at least 98%, or at least 99% homology to the amino acid sequence of SEQ ID NO: 355 (SSYLH). In another embodiment, the isolated antibody or fragment thereof comprises a light chain CDR2 sequence having at least 80%, at least 85%, at least 90%, at least 95% at least 96%, at least 97%, at least 98%, or at least 99% homology to the amino acid sequence of SEQ ID NO: 356 (STSNLAS). In another embodiment, the isolated antibody or fragment thereof comprises a light chain CDR3 sequence having at least 80%, at least 85%, at least 90%, at least 95% at least 96%, at least 97%, at least 98%, or at least 99% homology to the amino acid sequence of SEQ ID NO: 357 (HQYHRSPPTF).

In one embodiment, the isolated antibody or antigen binding fragment thereof comprises a heavy chain CDR1, CDR2, and CDR3 comprising amino acid sequences according to SEQ ID NOs: 352, 353, and 354, respectively. In another embodiment, the isolated antibody or antigen binding fragment thereof comprises a light chain CDR1, CDR2, and CDR3 comprising amino acid sequences according to SEQ ID NOs: 355, 356, and 357, respectively. In a further embodiment, the isolated antibody or antigen binding fragment thereof comprises a heavy chain CDR1, heavy chain CDR2, heavy chain CDR3, light chain CDR1, light chain CDR2, and light chain CDR3 comprising amino acid sequences according to SEQ ID NOs: 352, 353, 354, 355, 356, and 357, respectively. In a still further embodiment, the isolated antibody or fragment thereof is chimeric or humanized.

In still another embodiment, the isolated antibody or antigen binding fragment thereof comprises a light chain CDR1 comprising amino acid sequence according to SEQ ID NO: 833. In further embodiments, the isolated antibody or antigen binding fragment thereof comprises a light chain CDR2 selected from a group comprising amino acid sequence according to SEQ ID NOs: 694, 834 and 835. In still further embodiments, the isolated antibody or antigen binding fragment thereof comprises a light chain CDR3 selected from a group comprising amino acid sequence according to SEQ ID NOs: 779 and 836.

In an embodiment, the isolated antibody or antigen binding fragment thereof comprises a light chain CDR1 comprising amino acid sequence according to SEQ ID NO: 833, a light chain CDR2 comprising amino acid sequence according to SEQ ID NO: 694, and a light chain CDR3 comprising amino acid sequence according to SEQ ID NO: 836.

In another embodiment, the isolated antibody or antigen binding fragment thereof comprises a light chain CDR1 comprising amino acid sequence according to SEQ ID NO: 833, a light chain CDR2 comprising amino acid sequence according to SEQ ID NO: 835, and a light chain CDR3 comprising amino acid sequence according to SEQ ID NO: 836.

In yet another embodiment, the isolated antibody or antigen binding fragment thereof comprises a light chain CDR1 comprising amino acid sequence according to SEQ ID NO: 833, a light chain CDR2 comprising amino acid sequence according to SEQ ID NO: 694, and a light chain CDR3 comprising amino acid sequence according to SEQ ID NO: 357.

In still another embodiment, the isolated antibody or antigen binding fragment thereof comprises a light chain CDR1 comprising amino acid sequence according to SEQ ID NO: 833, a light chain CDR2 comprising amino acid sequence according to SEQ ID NO: 834, and a light chain CDR3 comprising amino acid sequence according to SEQ ID NO: 779.

In still another embodiment, disclosed herein is an isolated antibody or antigen binding fragment thereof that binds to cannabinoid receptor 1 (CB1), wherein the antibody or antigen binding fragment thereof comprises a light chain CDR1 comprising an amino acid sequence according to SEQ ID NOs: 355 or 833; a light chain CDR2 comprising an amino acid sequence according to SEQ ID NOs: 356, 694, 834, or 835; and a light chain CDR3 comprising an amino acid sequence according to SEQ ID NOs: 357, 779, or 836.

The person of skill in the art will understand that the heavy and light chain CDRs of the antibodies provided herein may be independently selected, or mixed and matched, to form an antibody or binding fragment thereof comprising any light chain CDR1, CDR2, and CDR3; and any heavy chain CDR1, CDR2, and CDR3 from the antibodies provided herein. The skilled person will further understand that the heavy and light chain variable regions of the antibodies provided herein may be independently selected, or mixed and matched, to form an antibody or binding fragment comprising any heavy and light chain from the antibodies provided herein.

In one embodiment, the antibody or antigen binding fragment thereof provided herein is a chimeric antibody or fragment containing heavy and light chain CDRs selected from the CDRs provided herein, or conservative variants of the CDRs provided herein. In another embodiment, the antibody or antigen binding fragment thereof provided herein is a humanized antibody or fragment containing heavy and light chain CDRs selected from the CDRs provided herein, or conservative variants of the CDRs provided herein. In one embodiment, the antibody or antigen binding fragment thereof provided herein comprises a light chain and/or a heavy chain comprising a sequence provided herein, or a conservative variant thereof. In one embodiment, the conservative variants have at least 80%, at least 85%, at least 90%, at least 95%, at least 96%, at least 97%, at least 98% or at least 99% homology to the reference sequence provided herein. In one embodiment, the conservative variants comprise 1, 2, 3, 4, 5, 6, 7, 8, 9, 10, or more amino acid substitutions, insertions, or deletions.

In some embodiments, the isolated antibody or antigen binding fragment thereof binds CB1 and exhibits reduced effector function. In one embodiment, the isolated antibody or antigen binding fragment thereof binds CB1 and comprises one or more Fc region modifications. In a further embodiment, the antibody or antigen binding fragment thereof binds CB1 and comprises an amino acid sequence comprising one or more mutations in the Fc region. In a further embodiment, the isolated antibody or antigen binding fragment thereof has a mutation at position 228 and/or 330 and/or 331. In another embodiment, the isolated antibody or antigen binding fragment thereof has a mutation at position 228 of the Fc region, wherein the Fc region is of the IgG4 isotype. In a further embodiment, the mutation is S228P. In another embodiment, the isolated antibody or antigen binding fragment thereof has a mutation at position 330 and/or position 331. In a further embodiment, the isolated antibody or antigen binding fragment thereof has a mutation at position 330 and/or 331, wherein the Fc region is of the IgG2 isotype. In a further embodiment, the isolated antibody or antigen binding fragment thereof has the following mutations in the Fc region: A330S and P331S. In another embodiment, the isolated antibody or antigen binding fragment thereof comprises an Fc region that is a hybrid Fc region. For example, in one embodiment, the Fc region is a hybrid IgG2/IgG4 Fc region, wherein the CH1 and hinge regions are derived from IgG2, and the CH2 and CH3 regions are derived from IgG4.

Thus, in one embodiment, the antibody or antigen binding fragment thereof provided herein is a chimeric or humanized antibody or fragment containing heavy and light chain CDRs selected from the CDRs provided herein, or conservative variants of the CDRs provided herein, wherein the isolated antibody or fragment thereof comprises an Fc region comprising modifications that alter antibody effector functions. For example, in one embodiment, the isolated antibody or antigen binding fragment thereof comprises light and heavy chain CDRs according to SEQ ID NOs: 352-357, or conservative variants thereof, and further comprises an IgG2-IgG4 hybrid Fc region, an IgG2 Fc region comprising amino acid mutations at positions 330 and 331 (e.g., A330S and P331S), or an IgG4 Fc region comprising an amino acid mutation at position 228 (e.g., S228P).

In one embodiment, the present invention provides an isolated antibody or antigen binding fragment thereof that binds to CB1, wherein the antibody or fragment has a binding affinity Kd for CB1 receptor of about 70 nM or less, about 60 nM or less, about 50 nM or less, about 40 nM or less, about 30 nM or less, about 25 nM or less, about 20 nM or less, about 15 nM or less, about 10 nM or less, about 8 nM or less, about 6 nM or less, about 5 nM or less, about 4 nM or less, about 3 nM or less, about 2 nM or less, or about 1 nM or less. In one embodiment, present invention provides an isolated antibody or fragment thereof that binds to CB1, wherein the antibody or fragment has a binding affinity Kd for CB1 receptor in the range of about 1 nM to about 100 nM, about 2 nM to about 75 nM, about 3 nM to about 50 nM, about 4 nM to about 10 nM, or has a binding affinity Kd for CB2 receptor that is about 50 nM, or about 40 nM, or about 30 nM, or about 20 nM, or about 10 nM, or about 5 nM, or about 4 nM, or about 3 nM or about 2 nM, or about 1 nM.

In one embodiment, the present invention provides an isolated antibody or antigen binding fragment thereof that is at least 2 fold, at least 3 fold, at least 4 fold, at least 5 fold, at least 6 fold, at least 7 fold, at least 8 fold, at least 9 fold, at least 10 fold, at least 11 fold, at least 12 fold, at least 13 fold, at least 14 fold, or at least 15 fold more potent than the small molecule rimonabant, wherein the potency of the antibody or fragment or rimonabant is measured by inhibition of CB1 receptor antagonist-mediated signal transduction in a cAMP assay. In a further embodiment, the isolated antibody or antigen binding fragment thereof is humanized.

In one embodiment, the present invention provides an isolated humanized antibody or antigen binding fragment thereof that binds to CB1, wherein the antibody or fragment exhibits greater binding affinity and/or greater potency than a corresponding non-humanized or chimeric antibody, wherein the humanized antibody or fragment and the corresponding non-humanized or chimeric antibody comprise the same heavy and light chain CDRs. For example, in one embodiment, the present invention provides a humanized antibody or fragment thereof comprising heavy chain CDR1, CDR2, and CDR3 and light chain CDR1, CDR2, and CDR3 according to SEQ ID NOs: 352, 353, 354, 355, 356, and 357, respectively, wherein the humanized antibody exhibits greater binding affinity for CB1 receptor and/or greater potency with respect to inhibition of CB1 receptor agonist. In one embodiment, the humanized antibodies and fragments provided herein exhibit at least 50% greater, at least 100% greater, at least 2 fold greater, at least 3 fold greater, at least 4 fold greater, at least 5 fold greater, or at least 10 fold greater potency relative to the corresponding non-humanized or chimeric antibody. In a further embodiment, the potency is measured by inhibition of CB1-cAMP production.

Potency of CB1 receptor antibodies provided herein may be measured by any method known in the art. For example, in one embodiment, potency of the antibodies and fragments provided herein is measured by intracellular cAMP levels or ERK phosphorylation. For example, potency may be measured by the level of inhibition cAMP production in a cAMP functional assay (Cisbio) or inhibition of WIN55,212-induced ERK phosphorylation in a Western blot.

In some embodiments, the present invention provides an antibody or antigen binding fragment thereof that is capable of competing with the antibody or antigen binding fragments thereof disclosed herein for binding to CB1 receptor. In some other embodiments, the present invention provides an antibody or antigen binding fragment thereof that is capable of specifically binding to essentially the same epitope on CB1 receptor as the antibodies or antigen binding fragments disclosed herein. Such antibodies can be identified using routine competition binding assays. In certain embodiments, competition is measured by ELISA, flow cytometry, or surface plasmon resonance (SPR) assay.

In some embodiments, the antibodies and fragments thereof are conjugated to one or more agents selected from the group including an additional therapeutic agent, a cytotoxic agent, an immunoadhesion molecule, and an imaging agent. In some embodiments, the imaging agent is selected from the group consisting of a radiolabel, an enzyme, a fluorescent label, a luminescent label, a bioluminescent label, a magnetic label, and biotin.

In one aspect, methods are provided for modulating the signaling activity of CB1 receptor comprising contacting a cell expressing CB1 receptor with the antibody or fragment thereof disclosed herein. In some embodiments, the methods provided result in inhibition of the activity of CB1 receptor signaling. In some embodiments, the methods provided result in increased activity of CB1 receptor signaling. In some embodiments, the modulation of CB1 receptor signaling activity is indirect, such as though an allosteric modulator. In some embodiments, the modulation of CB1 receptor signaling activity is biased for Galpha i/o mediated signaling versus beta arrestin mediated signaling.

In one aspect, methods for treating a disease or disorder responsive to antagonism or agonism of CB1 receptor in a subject in need thereof are provided. In some embodiments, the methods comprise administering to the subject an anti-CB1 receptor antibody or antigen binding fragment thereof as disclosed herein. In one embodiment, the subject is a mammal. In a further embodiment, the subject is a human. In some embodiments, the disease or disorder is obesity, diabetes, dyslipidemia, metabolic diseases, fibrosis, non-alcoholic steatohepatitis (NASH), liver disease, primary biliary cirrhosis, renal disease, kidney fibrosis, chronic kidney disease, osteoporosis, atherosclerosis, cardiovascular disease, cancer, an inflammatory disease, pain, MS spasticity, and ocular diseases, including glaucoma. In some embodiments, the disease or disorder is, for example, obesity, diabetes, fibrosis, liver disease, cardiovascular disease, or cancer, and the method provided results in inhibition of the activity of CB1 receptor. In some embodiments, the disease or disorder is, for example, pain or glaucoma, and the method provided results in activation or increase of CB1 receptor activity.

In one aspect, a method for detecting CB1 receptor in a cell, tissue, or subject is provided, the method comprising contacting a cell with a CB1 receptor binding antibody or antigen binding fragment provided herein. In one embodiment, the cell is present in a subject. In another embodiment, the cell is present in a human subject. In another embodiment, the CB1 receptor expression level on cells is correlated with a disease state. Thus, in one aspect, the present invention provides methods of using antibodies and fragments thereof that specifically bind to CB1 receptor as tools for the diagnosis and/or prognosis of human diseases. In one embodiment, the present invention provides methods for imaging CB1 receptor comprising the use of the CB1 receptor antibodies and fragments disclosed herein. In one embodiment, the method for detecting CB1 receptor is achieved with a CB1 receptor antibody or fragment thereof disclosed herein that selectively binds CB1 receptor. In a further embodiment, the selective CB1 receptor antibody or fragment thereof does not exhibit agonistic or antagonistic activity. In a further embodiment, the selective CB1 receptor antibody or fragment thereof does not internalize. In one embodiment, the present invention provides diagnostic and imaging methods comprising the use of a CB1 receptor antibody or fragment that is conjugated to an imaging agent such as, for example, a radiolabel, an enzyme, a fluorescent label, a luminescent label, a bioluminescent label, a magnetic label, or biotin.

In one embodiment, the invention provides a host cell expressing an isolated antibody or fragment thereof that specifically binds to CB1 receptor. In another embodiment, a method for making an antibody or fragment thereof that specifically binds to CB1 receptor is provided, the method comprising immunizing mammals with purified CB1 receptor or an antigenic fragment thereof, CB1/lipid complexes, CB1 receptor iCAPS, and/or CB1 receptor DNA. In a further embodiment, the immunized mammals are mice. In another embodiment, the mammals are immunized one, two, three, four, five, or more times with purified CB1 or an antigenic fragment thereof, CB1/lipid complex, CB1 receptor iCAPS, and/or CB1 receptor DNA prior to harvesting cells from the immunized mammals. In a further embodiment, the antibody or fragment thereof that specifically binds to CB1 receptor is generated from a hybridoma cell line comprising cells derived from the immunized mammals. In another embodiment, the antibody or fragment thereof that specifically binds to CB1 receptor is generated from a phage display library. In a further embodiment, the phage display library is derived from cells isolated from the immunized mammals. In a further embodiment, the phage display library is derived from naïve human immunoglobulin sequences.

BRIEF DESCRIPTION OF THE FIGURES

FIG. 1F is a set of histograms showing binding of PA2LR3-P1G6 (left column), PA2LR3-P1H4 (middle column), or PA2LR3-P2B8 (right column) to Trex-CHO parental cell line (no CB1 receptor expression; top row), Trex-CHO CB1 T210A/fusion partner cell line (overexpressed CB1; middle row), or Trex-CHO A156 cell line (native human CB1 receptor expressing; bottom row).

FIG. 9A shows that CB1 antibodies do not block WIN55,212 induced receptor internalization. The top row of histograms in FIG. 9A shows surface expression of CB1 following treatment with WIN55,212 or control, or pre-treatment with CB1 specific neutral antagonist AM6545 followed by WIN55,212. The middle and bottom rows of histograms in FIG. 9A show surface expression of CB1 following pre-treatment with CB1 antibodies PA2LR3-P3A8, PA2LR3-P3F8, PA2LR3-P5B11, PA2LR3-P5E7, PA2LR3-P6B12, PA2LR3-P6G7, PA3R3-P4D5, PA2LR3-P4B1, PA2LR3-P4B5, PA2LR3-P4C6, and PA2LR3-P4G10, or negative control P2A12 followed by treatment with WIN55,212. FIG. 9B shows that CB1 antibodies alone do not induce CB1 receptor internalization. The top row of histograms in FIG. 9B show surface expression of CB1 following treatment with WIN55,212 or control, or pre-treatment with CB1 specific neutral antagonist AM6545 followed by WIN55,212. The middle and bottom rows of histograms in FIG. 9B show surface expression of CB1 following treatment with CB1 antibodies PA2LR3-P3A8, PA2LR3-P3F8, PA2LR3-P5B11, PA2LR3-P5E7, PA2LR3-P6B12, PA2LR3-P6G7, PA3R3-P4D5, PA2LR3-P4B1, PA2LR3-P4B5, PA2LR3-P4C6, and PA2LR3-P4G10, or negative control P2A12

FIG. 13A shows the detection of labeled P4B5 antibody in the heart, lungs, liver, kidneys, stomach, intestines, and bladder at time points 0 h, 1 h, 5 h, 24 h, 48 h, 72 h, 96 h, and 144 h (13A.1); and the detection of labeled P4B5 antibody in the brain at timepoints 0 h, 1 h, 5 h, 24 h, 48 h, 72 h, 96 h, and 144 h (13A.2).

FIG. 14 shows the SEC profiles and SDS-PAGE analyses for PA13R3-P1C4 humanized variants expressed in 293 and CHO-K1 cells.

FIG. 20, E-M show binding selectivity and cross-reactivity of humanized PA13R3-P1C4 variants to human CB1 versus human CB2 and mouse CB1.

FIG. 22 shows antibody mediated cytotoxicity and complement dependent cytotoxicity of humanized P1C4 variants P1C4-h2-IgG2 and P1C4-h2-IgG4 in Daudi cells.

DETAILED DESCRIPTION

Figure 1A:
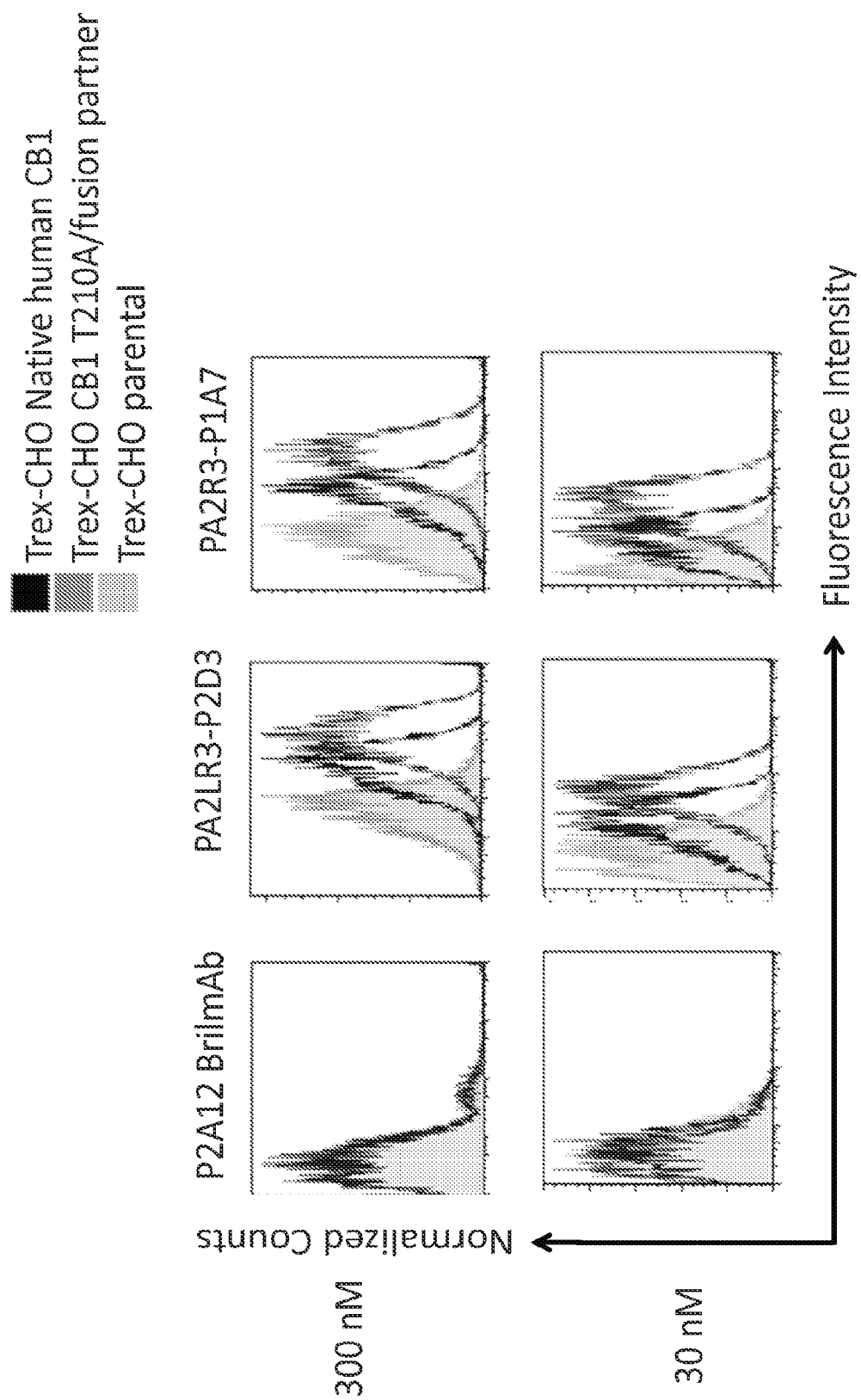
FIG. 1A is a set of histograms showing binding of P2A12 Bril mAb (left column), PA2LR3-P2D3 (middle column), or PA2R3-P1A7 (right column) at 300 nM (top row) or 30 nM (bottom row) to Trex-CHO Native human CB1 cell line (native CB1 receptor expressing; dark gray lines), Trex-CHO CB1 T210A/fusion partner (overexpressed CB1; medium gray lines), or Trex-CHO parental cell line (no CB1 receptor expression; light gray lines).
Figure 1B:
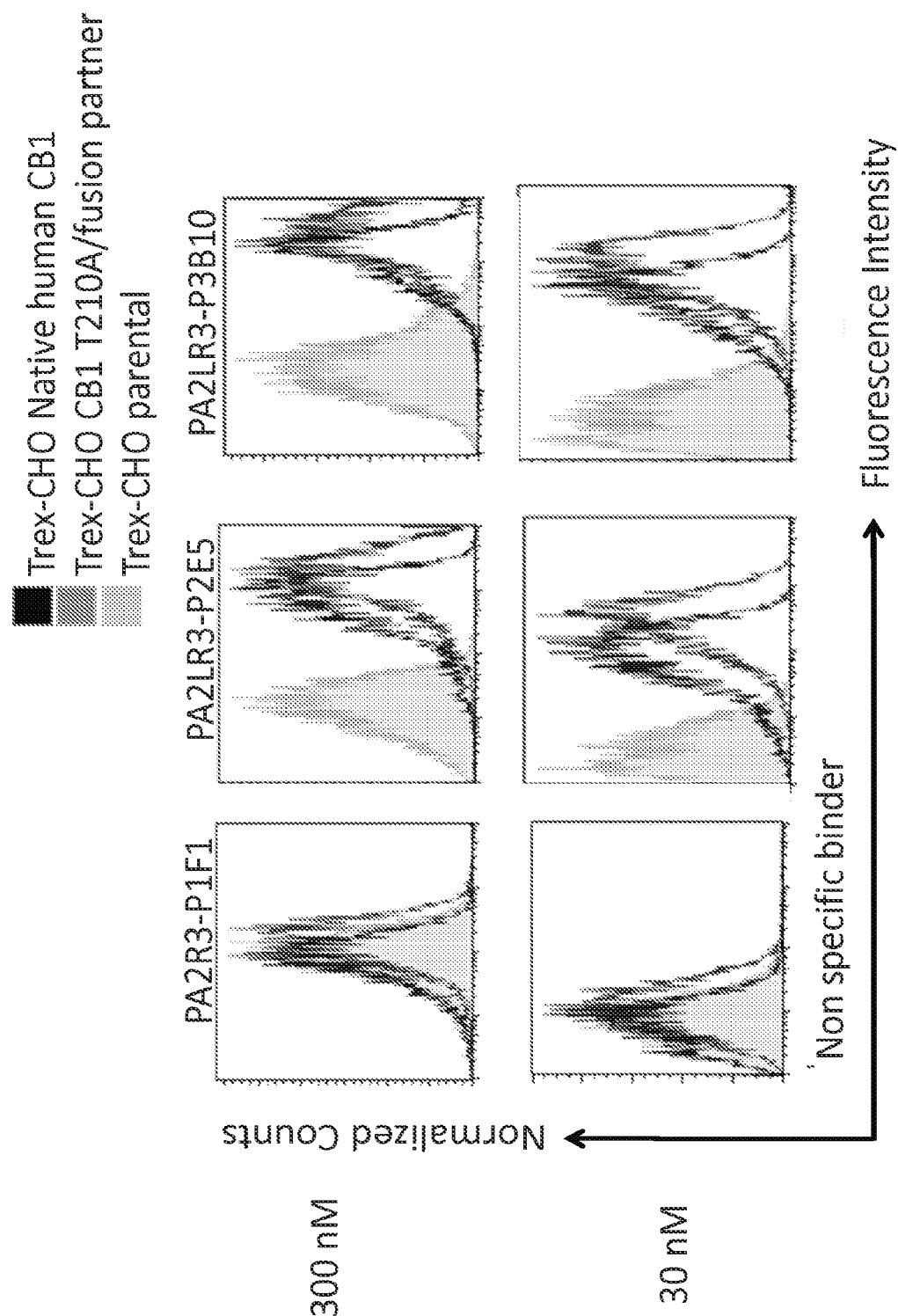
FIG. 1B is a set of histograms showing binding of PA2R3-P1F1 (left column), PA2LR3-P2E5 (middle column), or PA2LR3-P3B10 (right column) at 300 nM (top row) or 30 nM (bottom row) to Trex-CHO Native CB1 cell line (native human CB1 receptor expressing; dark gray lines), Trex-CHO CB1 T210A/fusion partner (overexpressed CB1; medium gray lines), or Trex-CHO parental cell line (no CB1 receptor expression; light gray lines).
Figure 1C:
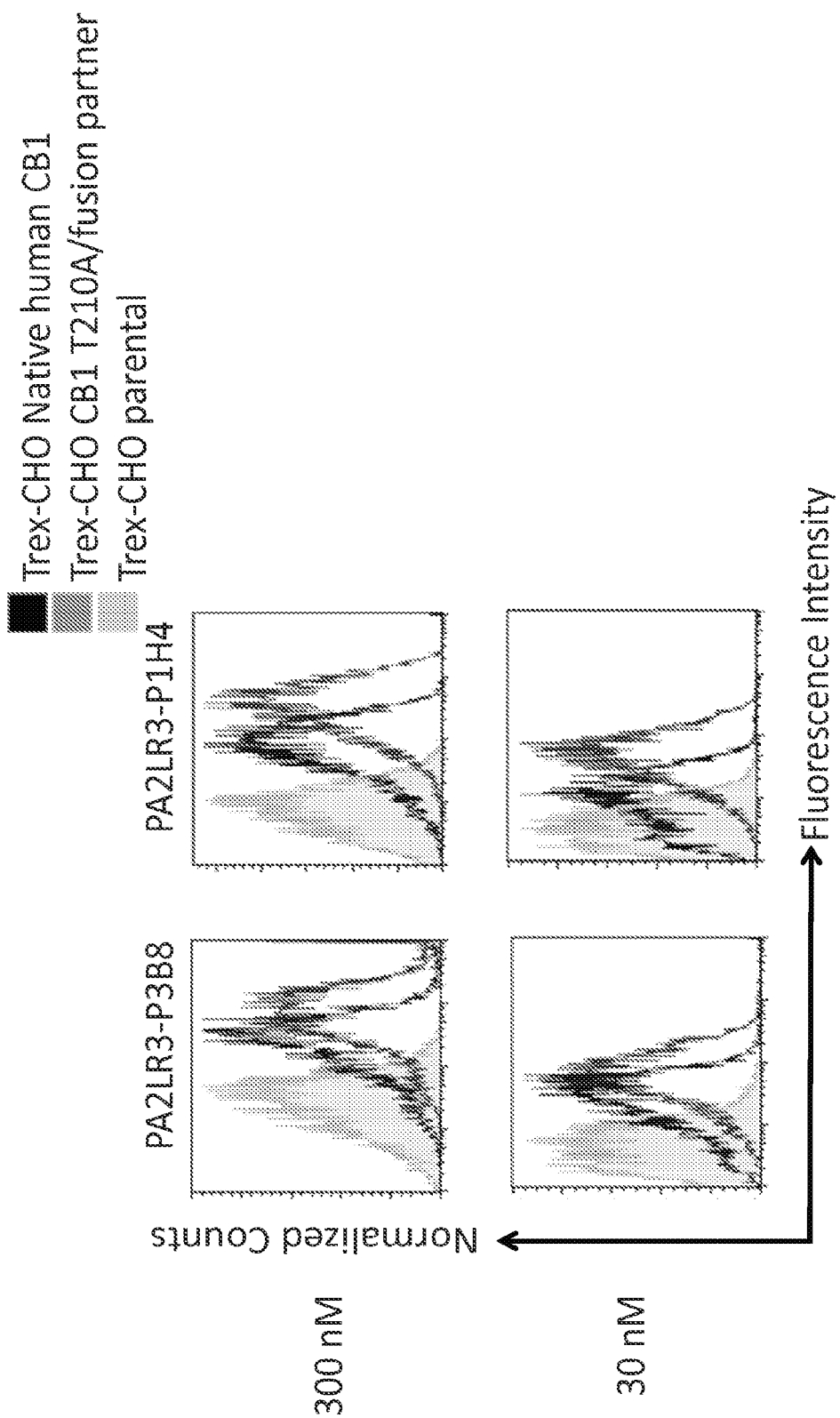
FIG. 1C is a set of histograms showing binding of PA2LR3-P3B8 (left column) or PA2LR3-P1H4 (right column) at 300 nM (top row) or 30 nM (bottom row) to Trex-CHO Native human CB1 cell line (native CB1 receptor expressing; dark gray lines), Trex-CHO CB1 T210A/fusion partner (overexpressed CB1; medium gray lines), or Trex-CHO parental cell line (no CB1 receptor expression; light gray lines).
Figure 1D:
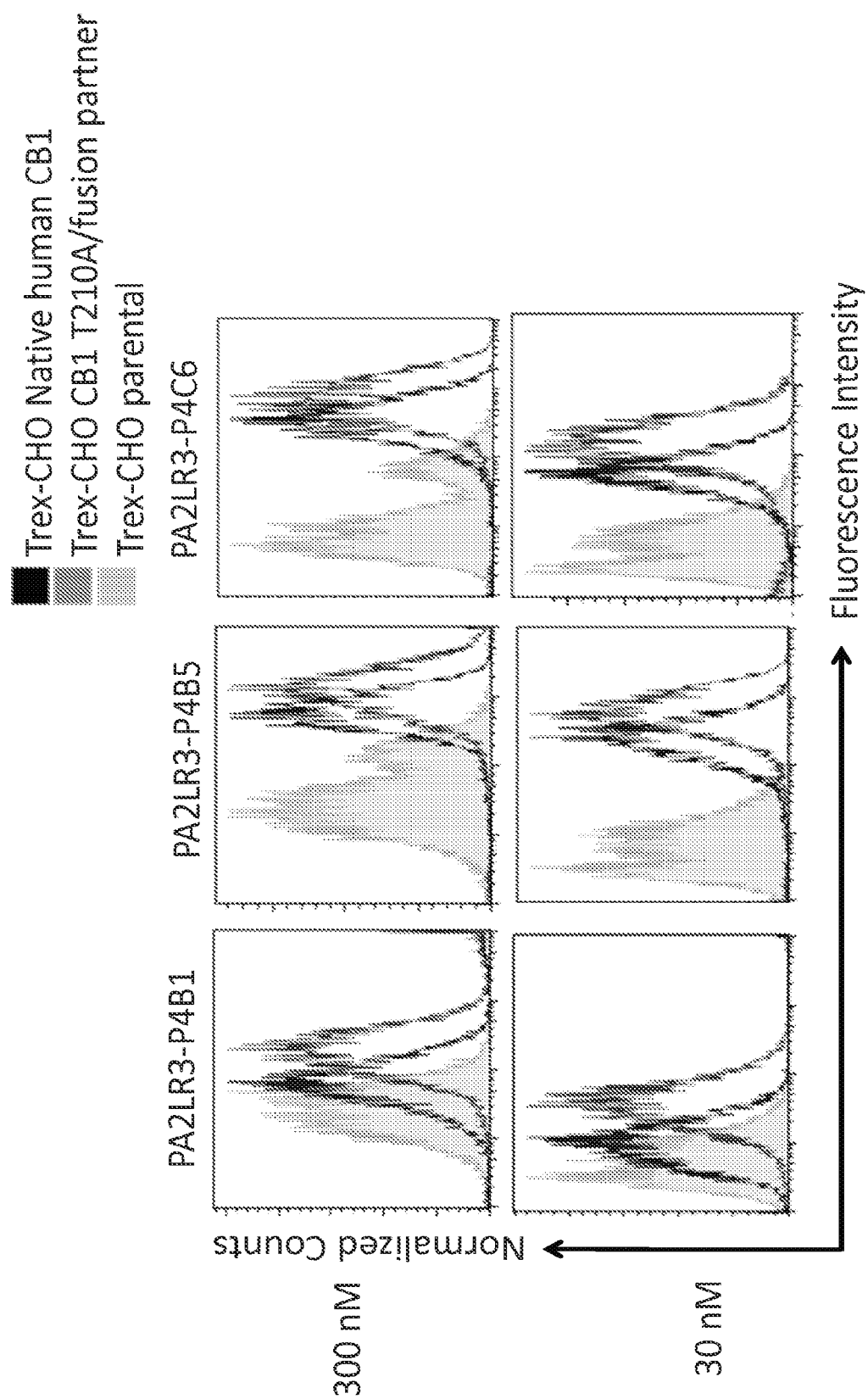
FIG. 1D is a set of histograms showing binding of PA2LR3-P4B1 (left column), PA2LR3-P4B5 (middle column), or PA2LR3-P4C6 (right column) at 300 nM (top row) or 30 nM (bottom row) to Trex-CHO Native human CB1 cell line (native CB1 receptor expressing; dark gray lines), Trex-CHO CB1 T210A/fusion partner (overexpressed CB1; medium gray lines), or Trex-CHO parental cell line (no CB1 receptor expression; light gray lines).
Figure 1E:
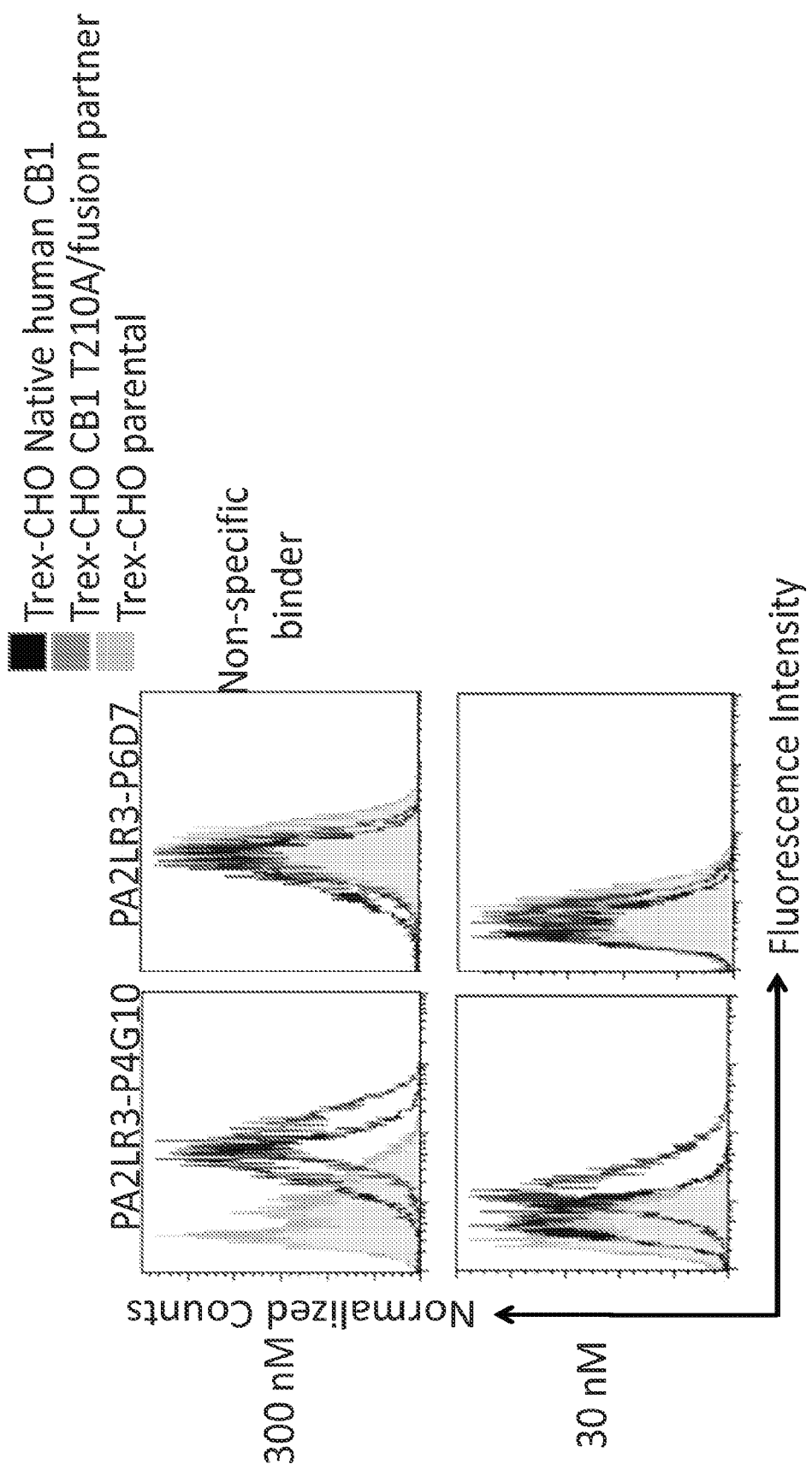
FIG. 1E is a set of histograms showing binding of PA2LR3-P4G10 (left column) or PA2LR3-P6D7 (right column) at 300 nM (top row) or 30 nM (bottom row) to Trex-CHO Native human CB1 cell line (native CB1 receptor expressing; dark gray lines), Trex-CHO CB1 T210A/fusion partner (overexpressed CB1; medium gray lines), or Trex-CHO parental cell line (no CB1 receptor expression; light gray lines).

In one aspect, the present invention provides antigen binding proteins such as antibodies and antigen-binding fragments thereof that bind selectively to human cannabinoid 1 (CB1) receptor. The antibodies and fragments thereof are functional antibodies that agonize or antagonize CB1 receptor, or are selectively recognizing CB1 without agonist or antagonist activity.

As used herein, the term "antibody" refers to binding proteins having at least one antigen-binding domain and includes monoclonal antibodies fragments and/or variants thereof including recombinant polypeptides, fusion proteins, and immunoconjugates. Thus, the terms "antibody," "antibody fragment," and "antibody variant" are used interchangeably herein. Examples of antibody fragments of the invention include, but are not limited to, the Fab fragment, consisting of VL, VH, CL and CHI domains; the Fc fragment, consisting of the VH and CHI domains; the Fv fragment consisting of the VL and VH; the dAb fragment consisting of a VH domain; isolated CDR regions; F(ab')$_2$ a bivalent fragment comprising two linked Fab fragments; and single chain Fv molecules (scFv). The CB1 receptor binding antibodies provided herein may be generated from any species including, but not limited to, mouse, rat, rabbit, primate, llama and human. The CB1 receptor binding antibodies may be chimeric, humanized, or fully human antibodies.

As used herein, the term "derived" when used to refer to a molecule or polypeptide relative to a reference antibody or other binding protein, means a molecule or polypeptide that is capable of binding with specificity to the same epitope as the reference antibody or other binding protein.

The use of the singular includes the plural unless specifically stated otherwise. The word "a" or "an" means "at least one" unless specifically stated otherwise. The use of "or" means "and/or" unless stated otherwise. The meaning of the phrase "at least one" is equivalent to the meaning of the phrase "one or more." Furthermore, the use of the term "including," as well as other forms, such as "includes" and "included," is not limiting. Also, terms such as "element" or "component" encompass both elements or components comprising one unit and elements or components comprising more than one unit unless specifically stated otherwise.

The antibodies and antigen-binding fragments thereof disclosed herein are specific for cannabinoid 1 (CB1) receptor. By "specific for" is meant that the antibodies and fragments thereof bind CB1 receptor with greater affinity (i.e., a lower binding affinity Kd value) than any other target. Thus, antibodies and fragments thereof that are selective for CB1 receptor bind CB1 receptor with greater affinity (i.e., a lower binding affinity Kd value) than any other cannabinoid receptor or any other GPCR or any other target. The antibodies and fragments or variants thereof may have a binding affinity Kd value for CB1 receptor in the range of about 0.01 nM to about 500 nM, about 0.02 nM to about 250 nM, about 0.02 to about 200 nM, about 0.05 to about 100 nM, about 0.05 to about 50 nM. The antibodies and fragments thereof may have a binding affinity Kd value for CB1 receptor of about 500 nM, about 250 nM, about 200 nM, about 150 nM, about 100 nM, about 75 nM, about 50 nM, about 25 nM, about 10 nM, about 5 nM, about 1 nM, about 500 pM, about 250 pM, about 100 pM, about 50 pM, or about 10 pM. The antibodies and fragments thereof may have a binding affinity Kd value for CB1 receptor of about 100 nM or less, about 75 nM or less, about 50 nM or less, about 10 nM or less, about 1 nM or less, about 500 pM or less, or about 100 pM or less.

As used herein, the term "agonist" refers to a compound that enhances the signaling activity of another compound or receptor site.

As used herein, the term "antagonist" refers to a compound that inhibits, diminishes or prevents the signaling activity of another compound at a receptor site and more generally refer to a compound that diminishes or prevents the activation and/or the signaling activity of a receptor.

An "allosteric modulator" is a compound that indirectly modulates the agonistic effects of another compound. For example, an allosteric modulator may indirectly modulate the agonistic effect of a receptor agonist by inducing a conformational change within the protein structure. Allosteric modulators may be positive (amplify the agonistic effect of the agonist compound) or negative (diminish the effect of the agonist compound) modulators.

As used herein, the terms "treatment" or "treating" refers to both therapeutic treatment and prophylactic or preventive measures. A subject in need of treatment is a subject that already has the disease or disorder as well as those that may develop the disease or disorder and in whom the object is to prevent, delay, or diminish the disease or disorder. The methods of "treatment" disclosed herein employ administration to a subject, an antibody or antigen binding fragment disclosed herein, for example, a subject having a CB1-associated disease or disorder (e.g., a fibrotic disease) or predisposed to having such a disease or disorder, in order to prevent, cure, delay, reduce the severity of, or ameliorate one or more symptoms of the disease or disorder or recurring disease or disorder, or in order to prolong the survival of a subject beyond that expected in the absence of such treatment. As used herein, the term "subject" denotes a mammal, such as a rodent, a feline, a canine, and a primate. Preferably a subject according to the invention is a human.

A "therapeutically effective amount," as used herein, refers to the amount of a compound or composition that is necessary to provide a therapeutic and/or preventative benefit to the subject. A therapeutically effective amount will vary depending upon the subject and disease condition being treated, the weight and age of the subject, the severity of the disease condition, the manner of administration and the like, which can readily be determined by one of ordinary skill in the art. The dosages for administration can range from, for example, about 1 ng to about 10,000 mg, about 1 ug to about 5,000 mg, about 1 mg to about 1,000 mg, about 10 mg to about 100 mg, of an antibody or antigen binding fragment thereof, disclosed herein. Dosage regiments may be adjusted to provide the optimum therapeutic response. An effective amount is also one in which any toxic or detrimental effects (i.e., side effects) of an antibody or antigen binding fragment thereof are minimized or outweighed by the beneficial effects.

I. Modified Anti-CB1 Antibodies

In certain embodiments, anti-CB1 receptor antibodies disclosed herein may comprise one or more modifications. Modified forms of anti-CB1 receptor antibodies disclosed herein can be made using any techniques known in the art. Non-exhaustive examples of modified anti-CB1 receptor antibodies are disclosed in U.S. application Ser. No. 14/774,582, filed Sep. 10, 2015, International Application No. PCT/US15/23108, filed Mar. 27, 2015, International Application No. PCT/CN2014/074199, filed Mar. 27, 2014, and International Application No. PCT/CN2014/081797, filed Jul. 8, 2014, the disclosures of each of which are incorporated herein by reference in their entireties.

In some embodiments, the anti-CB1 receptor antibodies and fragments thereof are conjugates further comprising an agent selected from the group including an additional therapeutic agent, a cytotoxic agent, an immunoadhesion molecule, and an imaging agent. In some embodiments, the imaging agent is selected from the group consisting of a radiolabel, an enzyme, a fluorescent label, a luminescent label, a bioluminescent label, a magnetic label, and biotin. In some embodiments, the imaging agent is a radiolabel selected from the group consisting of: $^{3}$H, $^{14}$C, $^{35}$S, $^{64}$Cu, $^{89}$Zr, $^{90}$Y, $^{99}$Tc, $^{111}$In, $^{125}$I, $^{131}$I, $^{177}$Lu, $^{166}$Ho, and $^{153}$Sm. In some embodiments, the therapeutic agent or cytotoxic agent is selected from the group including an immunosuppressive agent, an immuno-stimulatory agent, an anti-metabolite, an alkylating agent, an antibiotic, a growth factor, a cytokine, an anti-angiogenic agent, an anti-mitotic agent, an anthracycline, a toxin, and an apoptotic agent.

In one embodiment, the isolated anti-CB1 receptor antibody or antigen binding fragment disclosed herein is conjugated to a CB1 antagonist. Non-limiting examples of known CB1 antagonists include rimonabant, taranabant, VD60, Isis-414930 Antisense CB1, JD5037, AM6545, and TM38837. In one embodiment, the isolated anti-CB1 receptor antibody or antigen binding fragment disclosed herein is conjugated to rimonabant. In one embodiment, the isolated antibody or antigen binding fragment thereof that is conjugated to the cytotoxic agent is a CB1 receptor agonist. In another embodiment, the isolated antibody or antigen binding fragment that is conjugated to the cytotoxic agent is a CB1 receptor neutral binder that allows receptor internalization to occur.

In another aspect, the isolated anti-CB1 receptor antibody or antigen binding fragment disclosed herein is conjugated to a chemotherapeutic agent. A "chemotherapeutic agent" is a chemical compound useful in the treatment of cancer. Examples of chemotherapeutic agents include alkylating agents such as thiotepa and CYTOXAN® cyclophosphamide; alkyl sulfonates such as busulfan, improsulfan and piposulfan; aziridines such as benzodopa, carboquone, meturedopa, and uredopa; ethylenimines and methylamelamines including altretamine, triethylenemelamine, triethylenephosphoramide, triethylenethiophosphoramide and trimethylolomelamine; acetogenins (especially bullatacin and bullatacinone); a camptothecin (including the synthetic analogue topotecan); bryostatin; callystatin; CC-1065 (including its adozelesin, carzelesin and bizelesin synthetic analogues); cryptophycins (particularly cryptophycin 1 and cryptophycin 8); dolastatin; duocarmycin (including the synthetic analogues, KW-2189 and CB1-TM1); eleutherobin; pancratistatin; a sarcodictyin; spongistatin; nitrogen mustards such as chlorambucil, chlornaphazine, cholophosphamide, estramustine, ifosfamide, mechlorethamine, mechlorethamine oxide hydrochloride, melphalan, novembichin, phenesterine, prednimustine, trofosfamide, uracil mustard; nitrosureas such as carmustine, chlorozotocin, fotemustine, lomustine, nimustine, and ranimustine; antibiotics such as the enediyne antibiotics (e.g., calicheamicin, especially calicheamicin gamma 11 and calicheamicin omega 11 (see, e.g., Agnew, Chem Intl. Ed. Engl., 33: 183-186 (1994)); dynemicin, including dynemicin A; bisphosphonates, such as clodronate; an esperamicin; as well as neocarzinostatin chromophore and related chromoprotein enediyne antibiotic chromophores), aclacinomysins, actinomycin, authramycin, azaserine, bleomycins, cactinomycin, carabicin, carminomycin, carzinophilin, chromomycinis, dactinomycin, daunorubicin, detorubicin, 6-diazo-5-oxo-L-norleucine, ADRIAMYCIN® doxorubicin (including morpholino-doxorubicin, cyanomorpholino-doxorubicin, 2-pyrrolino-doxorubicin and deoxydoxorubicin), epirubicin, esorubicin, idarubicin, marcellomycin, mitomycins such as mitomycin C, mycophenolic acid, nogalamycin, olivomycins, peplomycin, potfiromycin, puromycin, quelamycin, rodorubicin, streptonigrin, streptozocin, tubercidin, ubenimex, zinostatin, zorubicin; anti-metabolites such as methotrexate and 5-fluorouracil (5-FU); folic acid analogues such as denopterin, methotrexate, pteropterin, trimetrexate; purine analogs such as fludarabine, 6-mercaptopurine, thiamiprine, thioguanine; pyrimidine analogs such as ancitabine, azacitidine, 6-azauridine, carmofur, cytarabine, dideoxyuridine, doxifluridine, enocitabine, floxuridine; androgens such as calusterone, dromostanolone propionate, epitiostanol, mepitiostane, testolactone; anti-adrenals such as aminoglutethimide, mitotane, trilostane; folic acid replenisher such as frolinic acid; aceglatone; aldophosphamide glycoside; aminolevulinic acid; eniluracil; amsacrine; bestrabucil; bisantrene; edatraxate; defofamine; demecolcine; diaziquone; elfornithine; elliptinium acetate; an epothilone; etoglucid; gallium nitrate; hydroxyurea; lentinan; lonidainine; maytansinoids such as maytansine and ansamitocins; mitoguazone; mitoxantrone; mopidanmol; nitraerine; pentostatin; phenamet; pirarubicin; losoxantrone; podophyllinic acid; 2-ethylhydrazide; procarbazine; PSK® polysaccharide complex (JHS Natural Products, Eugene, Oreg.); razoxane; rhizoxin; sizofiran; spirogermanium; tenuazonic acid; triaziquone; 2,2',22"-trichlorotriethylamine; trichothecenes (especially T-2 toxin, verracurin A, roridin A and anguidine); urethan; vindesine; dacarbazine; mannomustine; mitobronitol; mitolactol; pipobroman; gacytosine; arabinoside ("Ara-C"); cyclophosphamide; thiotepa; taxoids, e.g., TAXOL® paclitaxel (Bristol-Myers Squibb Oncology, Princeton, N.J.), ABRAXANE™ Cremophor-free, albumin-engineered nanoparticle formulation of paclitaxel (American Pharmaceutical Partners, Schaumberg, Ill.), and TAXOTERE® doxetaxel (Rhone-Poulenc Rorer, Antony, France); chloranbucil; GEMZAR® gemcitabine; 6-thioguanine; mercaptopurine; methotrexate; platinum analogs such as cisplatin and carboplatin; vinblastine; platinum; etoposide (VP-16); ifosfamide; mitoxantrone; vincristine; NAVELBINE® vinorelbine; novantrone; teniposide; edatrexate; daunomycin; aminopterin; xeloda; ibandronate; CPT-11; topoisomerase inhibitor RFS 2000; difluoromethylornithine (DMFO); retinoids such as retinoic acid; capecitabine; and pharmaceutically acceptable salts, acids or derivatives of any of the above. Also included in the definition are proteasome inhibitors such as bortezomib (Velcade), BCL-2 inhibitors, IAP antagonists (e.g. Smac mimics/xIAP and cIAP inhibitors such as certain peptides, pyridine compounds such as (S)—N-{6-benzo [1,3]dioxol-5-yl-1-[5-(4-fluoro-benzoyl)-pyridin-3-ylmethyl]-2-oxo-1,2-dihydro-pyridin-3-yl}-2-methylamino-propionamide, xIAP antisense), HDAC inhibitors (HDACI) and kinase inhibitors (Sorafenib). In one embodiment, the isolated antibody or antigen binding fragment that is conjugated to the cytotoxic agent is a CB1 receptor agonist.

In some embodiments, the binding protein is conjugated directly to the agent. In other embodiments, the binding protein is conjugated to the agent via a linker. Suitable linkers include, but are not limited to, amino acid and polypeptide linkers disclosed herein. Linkers may be cleavable or non-cleavable.

In certain embodiments, the antibodies and fragments thereof are bispecific or bi-functional antibodies. The term "bispecific antibodies" refers to molecules which combine the antigen-binding sites of two antibodies within a single molecule. Thus, a bispecific antibody is able to bind two different antigens simultaneously. A bispecific antibody typically is an artificial hybrid antibody having two different heavy chain/light chain pairs and two different binding sites or epitopes. Bispecific antibodies can be monoclonal, preferably human or humanized, antibodies that have binding specificities for at least two different antigens.

In one embodiment, the bispecific antibody and/or fragment thereof has binding specificities directed towards CB1 and a second target antigen. In certain embodiments, the bispecific antibody and/or fragment thereof has binding specificities directed toward CB1 and TGF-β, 2-AG, PDGF-β, IL-6, anandamide (AEA), or LOXL-2.

The antibodies and fragments disclosed herein may bind to one or more target antigens selected from the group consisting of carbonic anhydrase IX, alpha-fetoprotein, α-actinin-4, A3, antigen specific for A33 antibody, ART-4, B7, Ba 733, BAGE, BrE3-antigen, CA125, CAMEL, CAP-1, CASP-8/m, CCCL19, CCCL21, CD1, CD1a, CD2, CD3, CD4, CD5, CD8, CD11A, CD14, CD15, CD16, CD18, CD19, CD20, CD21, CD22, CD23, CD25, CD29, CD30, CD32b, CD33, CD37, CD38, CD40, CD40L, CD45, CD46, CD52, CD54, CD55, CD59, CD64, CD66a-e, CD67, CD70, CD74, CD79a, CD80, CD83, CD95, CD126, CD132, CD133, CD138, CD147, CD154, CDC27, CDK-4/m, CDKN2A, CXCR4, colon-specific antigen-p (CSAp), CEA (CEACAM5), CEACAM1, CEACAM6, c-met, DAM, EGFR, EGFRvIII, EGP-1, EGP-2, ELF2-M, Ep-CAM, Flt-1, Flt-3, folate receptor, G250 antigen, GAGE, gp100, GROB, HLA-DR, HM1.24, human chorionic gonadotropin (HCG) and its subunits, HER2/neu, HMGB-1, hypoxia inducible factor (HIF-1), HSP70-2M, HST-2, Ia, IGF-1R, IFN-γ, IFN-α, IFN-β, IL-2, IL-4R, IL-6R, IL-13R, IL-15R, IL-17R, IL-18R, IL-6, IL-8, IL-12, IL-15, IL-17, IL-18, IL-23, IL-25, insulin-like growth factor-1 (IGF-1), KC4-antigen, KS-1-antigen, KS1-4, Le-Y, LDR/FUT, macrophage migration inhibitory factor (MIF), MAGE, MAGE-3, MART-1, MART-2, NY-ESO-1, TRAG-3, mCRP, MCP-1, MIP-1A, MIP-1B, MIF, MUC1, MUC2, MUC3, MUC4, MUC5, MUM-1/2, MUM-3, NCA66, NCA95, NCA90, antigen specific for PAM-4 antibody, placental growth factor, p53, PLAGL2, prostatic acid phosphatase, PSA, PRAME, PSMA, PIGF, IGF, IGF-1R, IL-6, RS5, RANTES, T101, SAGE, S100, survivin, survivin-2B, TAC, TAG-72, tenascin, TRAIL receptors, TNF-α, Tn antigen, Thomson-Friedenreich antigens, tumor necrosis antigens, VEGFR, ED-B fibronectin, WT-1, 17-1A-antigen, complement factors C3, C3a, C3b, C5a, C5, an angiogenesis marker, bcl-2, bcl-6, Kras, cMET, an oncogene marker and an oncogene product (see, e.g., Sensi et al., Clin Cancer Res 2006, 12:5023-32; Parmiani et al., J Immunol 2007, 178:1975-79; Novellino et al. Cancer Immunol Immunother 2005, 54:187-207).

Methods for making bispecific antibodies are well known. Traditionally, the recombinant production of bispecific antibodies is based on the co-expression of two immunoglobulin heavy chain/light chain pairs, where the two heavy chains have different specificities (Milstein et al., Nature 305:537 (1983)). Because of the random assortment of immunoglobulin heavy and light chains, the hybridomas (quadromas) produce a potential mixture of ten different antibody molecules, of which only one has the correct bispecific structure. The purification of the correct molecule is usually accomplished by affinity chromatography steps. Similar procedures are disclosed in WO 93/08829 and in Traunecker et al., EMBO J 10:3655 (1991). Other methods for making bispecific antibodies are provided in, for example, Kufer et al., Trends Biotech 22:238-244, 2004.

Antibody variable domains with the desired binding specificities can be fused to immunoglobulin constant domain sequences. The fusion preferably is with an immunoglobulin heavy chain constant domain, comprising at least part of the hinge, $C_{H2}$, and $C_{H3}$ regions. It may have the first heavy chain constant region ($C_{H1}$) containing the site necessary for light chain binding present in at least one of the fusions. DNAs encoding the immunoglobulin heavy chain fusions and, if desired, the immunoglobulin light chain, are inserted into separate expression vectors, and are co-transformed into a suitable host organism. For further details of generating bispecific antibodies see, for example Suresh et al., Meth Enzym 121:210 (1986). A variety of recombinant methods have been developed for efficient production of bispecific antibodies, both as antibody fragments (Carter et al. (1995), J. Hematotherapy 4: 463-470; Pluckthun et al. (1997) Immunotechology 3: 83-105; Todorovska et al. (2001) J. Immunol. Methods 248: 47-66) and full length IgG formats (Carter (2001) J. Immunol. Methods 248: 7-15).

Unless otherwise stated, the practice of the present invention employs conventional molecular biology, cell biology, biochemistry, and immunology techniques that are well known in the art and described, for example, in Methods in Molecular Biology, Humana Press; Molecular Cloning: A Laboratory Manual, second edition (Sambrook et al., 1989), Current Protocols in Immunology (J. E. Coligan et al., eds., 1991); Immunobiology (C. A. Janeway and P. Travers, 1997); Antibodies (P. Finch, 1997); Antibodies: a practical approach (D. Catty., ed., IRL Press, 1988-1989); Monoclonal antibodies: a practical approach (P. Shepherd and C. Dean, eds., Oxford University Press, 2000); Phage display: a laboratory manual (C. Barbas III et al, Cold Spring Harbor Laboratory Press, 2001); and Using antibodies: a laboratory manual (E. Harlow and D. Lane (Cold Spring Harbor Laboratory Press, 1999).

In one aspect, the invention provides methods for producing the antibodies and fragments or variants described herein comprising immunizing mice with a CB1 receptor immunogen such as, for example, CB1 receptor DNA, CB1 receptor protein, or CB1/lipid complex. In some embodiments, mice are immunized 1, 2, 3, 4, 5, or more times. In some embodiments, mice are immunized with CB1 receptor DNA and the CB1 receptor response is boosted by further immunization with CB1 receptor DNA and/or purified CB1 receptor protein, membranes comprising CB1 receptor protein, or CB1 receptor iCAPS. In some embodiments, cells from immunized mice are used to generate hybridoma and phage libraries.

In some embodiments, CB1 receptor antibodies are generated by recovering B cells from immunized mice and generating CB1 receptor antibody-producing hybridoma cells. The generation of hybridomas is a technique well known in the art and involves fusion of antibody-producing cells with myeloma or other immortalized cells to generate the immortalized antibody-producing hybridoma cell line (see, for example, Kohler and Milstein, 1975, Nature, 256: 495). Monoclonal antibodies produced by the hybridoma cells can be isolated from the supernatant by conventional means of immunoglobulin purification such as precipitation, chromatography, ultrafiltration, centrifugation, gel electrophoresis, and/or any other method known in the art. Supernatants or isolated monoclonal antibodies may be tested for binding to CB1 receptor by assessing binding to CB1 receptor membranes relative to naïve membranes. For example, supernatants or isolated monoclonal antibodies may be tested for binding to CB1 receptor in an ELISA.

Another aspect of the invention provides methods of producing the antibodies and fragments or variants described herein comprising the use of a phage library. Methods for recombinantly generating antibodies via phage display technology are known in the art (see, for example, Winter et al., Annu. Rev. Immunol. 12:433-455 (1994), McCafferty et al., Nature 348: 552-553 (1990), and Clackson et al. Nature 352:624 (1991)). In some embodiments, spleens from immunized mice are used to isolate an array of anti-CB1 receptor antibodies and form a random combinatorial library of variable genes derived from those antibodies. In some embodiments, rather than utilizing the cells from immunized mice to generate the phage display library, the library is generated from variable heavy and light chain genes of human primary blood lymphocytes.

In some embodiments, the phage library is panned for CB1 receptor binding phage in at least 3 rounds of panning, and phage binders are subsequently screened for specific binding to CB1 receptor by ELISA. Specific binders may then be selected and converted into full antibodies.

In some embodiments, the antibodies and fragments provided herein are chimeric antibodies or humanized antibodies. Methods for generating chimeric and humanized antibodies are well known in the art and summarized, for example, in Lo, Benny, K. C., editor, in *Antibody Engineering: Methods and Protocols*, volume 248, Humana Press, New Jersey, 2004.

A "chimeric antibody" is an antibody having at least a portion of the heavy chain variable region and at least a portion of the light chain variable region derived from one species; and at least a portion of a constant region derived from another species. For example, in one embodiment, a chimeric antibody may comprise murine variable regions and a human constant region. A "humanized antibody" is an antibody containing complementarity determining regions (CDRs) that are derived from a non-human antibody; and framework regions as well as constant regions that are derived from a human antibody.

As used herein, the term "CDR" or "complementarity determining region" means the noncontiguous antigen combining sites found within the variable region of both heavy and light chain polypeptides. These particular regions have been described by Kabat et al., *J. Biol. Chem.* 252, 6609-6616 (1977) and Kabat et al., Sequences of protein of immunological interest. (1991), and by Chothia et al., *J. Mol. Biol.* 196:901-917 (1987) and by MacCallum et al., *J.*

*Mol. Biol.* 262:732-745 (1996) where the definitions include overlapping or subsets of amino acid residues when compared against each other. The Kabat definition is based on sequence variability. The IMGT unique numbering for all IG and TR V-regions of all species relies on the high conservation of the structure of the variable region (Lefranc, Mp et al., *Dev comp. Immunol.* 27:55-77, 2003). IMGT numbering, set up after aligning more than 5,000 sequences takes into account and combines the definition of the framework and CDRs. The Clothia definition is based on the location of the structural loop regions. The Contact definition (MacCallum et al.) is based on an analysis of the complex crystal structures and antibody-antigen interactions. The amino acid residues which encompass the CDRs as defined by each of the above cited references are set forth for comparison. In one embodiment disclosed herein, the term "CDR" is a CDR as defined by the Kabat definition. In another embodiment disclosed herein, the CDR is a CDR as defined by IMGT.

The CDRs generally are of importance for epitope recognition and antibody binding. However, changes may be made to residues that comprise the CDRs without interfering with the ability of the antibody to recognize and to bind the cognate epitope. For example, changes that do not impact epitope recognition, yet increase the binding affinity of the antibody for the epitope, may be made. Several studies have surveyed the effects of introducing one or more amino acid changes at various positions in the sequence of an antibody, based on the knowledge of the primary antibody sequence, on the properties thereof, such as binding and level of expression (Yang et al., 1995, J Mol Biol 254:392-403; Rader et al., 1998, Proc Natl Acad Sci USA 95:8910-8915; and Vaughan et al., 1998, Nature Biotechnology 16, 535-539).

Thus, equivalents of an antibody of interest can be generated by changing the sequences of the heavy and light chain genes in the CDR1, CDR2 or CDR3, or framework regions, using methods such as oligonucleotide-mediated site-directed mutagenesis, cassette mutagenesis, error-prone PCR, DNA shuffling or mutator-strains of *E. coli* (Vaughan et al., 1998, Nat Biotech 16:535-539; and Adey et al., 1996, Chap. 16, pp. 277-291, in Phage Display of Peptides and Proteins, eds. Kay et al., Academic Press). The methods of changing the nucleic acid sequence of the primary antibody can result in antibodies with improved affinity (Gram et al., 1992, Proc Natl Acad Sci USA 89:3576-3580; Boder et al., 2000, Proc Natl Acad Sci USA 97:10701-10705; Davies & Riechmann, 1996, Immunotech 2:169-179; Thompson et al., 1996, J Mol Biol 256:77-88; Short et al., 2002, J Biol Chem 277:16365-16370; and Furukawa et al., 2001, J Biol Chem 276:27622-27628).

For example, the CB1 antibodies provided herein may comprise CDRs derived from one or more murine antibodies and human framework and constant regions. Thus, in one embodiment, the humanized antibody provided herein binds to the same epitope on CB1 as the murine antibody from which the antibody's CDRs are derived. Exemplary humanized antibodies are provided herein. Additional humanized CB1 antibodies comprising the heavy and light chain CDRs provided herein, or variants thereof, may be generated using any human framework sequence, and are also encompassed in the present invention. In one embodiment, framework sequences suitable for use in the present invention include those framework sequences that are structurally similar to the framework sequences provided herein. In some embodiments, human frameworks were selected based on homology between the parent antibody and the human germline VH and VK genes. Selected frameworks, in some embodiments, had the highest homology with the parent antibody VH and VK genes and also were predicted, based on computer modeling or other means, to support the CDR structure predicted to be presented by the parent antibody.

Further modifications in the framework regions may be made to improve the properties of the antibodies provided herein. Such further framework modifications may include chemical modifications; point mutations to reduce immunogenicity or remove T cell epitopes; or back mutation to the residue in the original germline sequence. In one embodiment of the present invention, the humanized antibodies and fragments thereof comprise a human framework and grafted CDRs provided herein, without further modifications to the variable region. Humanized antibodies that do not comprise a human framework backmutation are herein termed H0 (e.g., P1C4-H0). In another embodiment of the present invention, the humanized antibodies and fragments thereof comprise a human framework and grafted CDRs provided herein, wherein the amino acid at position 27 and/or 28 of the heavy chain framework region 1 is backmutated. In a further embodiment, the amino acid at position 27 is backmutated from Gly (G) to Tyr (Y); and the amino acid at position 28 is backmutated from Thr (T) to Glu (E). Humanized antibodies having such mutations at positions 27 and 28 are herein described as "H2" or "H2 (YE)" (e.g., P1C4-H2 or P1C4-H2 (YE)). In another embodiment of the present invention, the humanized antibodies and fragments thereof comprise a human framework and grafted CDRs provided herein, wherein the amino acid at position 27 and/or 28 of the heavy chain framework region 1 and the amino acid at position 60 and/or 61 of the heavy chain framework region 3 is backmutated. In a further embodiment, the amino acid at position 27 is backmutated from Gly (G) to Tyr (Y); the amino acid at position 28 is backmutated from Thr (T) to Glu (E); the amino acid at position 60 is backmutated from Ala (A) to Asn (N); and the amino acid at position 61 is backmutated from Gln (Q) to Gly (G). Humanized antibodies having such mutations at positions 27, 28, 60, and 61 are herein described as "H4" or "H4 (YENG)" (e.g., P1C4-H4 or P1C4-H4 (YENG)). In one embodiment of the present invention, the antibodies and antigen binding fragments thereof comprise framework modifications such as backmutations in the light chain. For example, in one embodiment, the antibodies comprise a mutation at position 45 and/or 47 of the light chain framework region 2. In a further embodiment, the amino acid at position 45 is mutated from Arg (R) to Lys (K) and the amino acid at position 47 is mutated from Leu (L) to Trp (W). The present invention also encompasses humanized antibodies that bind to CB1 and comprise framework modifications corresponding to the exemplary modifications described herein with respect to any suitable framework sequence, as well as other framework modifications that otherwise improve the properties of the antibodies. The CB1 antibodies and fragments thereof disclosed herein may be of an IgG1, IgG2, IgG3, or IgG4 isotype, or any combination thereof. The term "isotype" refers to the antibody class encoded by the heavy chain constant region genes. In addition, the heavy chain constant region may be derived from any species including, but not limited to, mouse, rat, rabbit, hamster, guinea pig, primate, llama or human. For example, in one embodiment, the CB1 antibodies and fragments thereof of the present invention comprise a human IgG1 Fc constant region. In another embodiment, the CB1 antibodies and fragments thereof comprise a human IgG2, human IgG4, or hybrid IgG2-IgG4 Fc constant region.

II. Effector Functions and Fc Modifications

In some embodiments, present invention provides CB1 antibodies comprising variant Fc regions. The Fc region of an antibody is the portion of the antibody that binds to Fcγ receptors (FcγRs) and the complement molecule C1q. The Fc region plays a role in mediating antibody effector functions. "Effector functions," as used herein in connection with antibody Fc, refers to antibody functions such as, for example, C1q binding; complement dependent cytotoxicity (CDC); Fc receptor binding; antibody-dependent cell-mediated cytotoxicity (ADCC); phagocytosis; opsonization; transcytosis; and down-regulation of cell surface receptors (e.g. B cell receptor). Such effector functions generally require the Fc region to be combined with a binding domain (e.g. an antibody variable domain) and can be assessed using various assays known in the art for evaluating such antibody effector functions. Variant Fc regions are Fc regions that comprise modifications that alter effector functions. In some embodiments, the CB1 antibodies provided herein comprise Fc region modifications that reduce, impair, or eliminate one or more effector functions. For example, in one embodiment, the antibodies and fragments thereof disclosed herein bind CB1 and exhibit reduced, impaired, or absent C1q binding and/or CDC and/or ADCC. Fc modifications may be amino acid insertions, deletions, or substitutions, or may be chemical modifications. For example, Fc region modifications may be made to increase or decrease complement binding; to increase or decrease antibody-dependent cellular cytotoxicity; or to modify glycosylation. Various Fc modifications are known in the art and have been described, for example, in Labrijin et al., Nature Biotech 27(8):767-71 (2009); Idusogie, et al. J Immunol 2000; Greenwood et al Eur J Immunol 23:1098-104 (1993); Mueller et al. Mol Immunol 1997; 34:441-52; and Rother et al Nature Biotechnol 2007; 25:1256-64. Any of the Fc modifications known in the art may be applied to the exemplary CB1 antibodies disclosed herein to alter effector function. Moreover, various therapeutic antibodies have been engineered to have Fc region modifications to alter effector function. Such therapeutic antibodies are known in the art and include, for example, alemtuzumab, benralizumab, bevacizumab, bimekizumab, cantuzumab, codrituzumab, dalotuzumab, efalizumab, elotuzumab, enavatuzumab, enokizumab, etrolizumab, farletuzumab, ficlatuzumab, imgatuzumab, itolizumab, lifastuzumab, ligelizumab, lodelcizumab, lorvotuzumab, mogamulizumab, motavizumab, obinutuzumab, ocaratuzumab, omalizumab, parsatuzumab, pateclizumab, perakizumab, pertuzumab, pidilizumab, quilizumab, rontalizumab, sofituzumab, solanezumab, suvizumab, teplizumab, tildrakizumab, tocilizumab, trastuzumab, trastuzumab emtansine, tregalizumab, vedolizumab, vorsetuzumab, vorsetuzumab mafodotin, yttrium (90 Y) clivatuzumab tetraxetan, anrukinzumab, dacetuzumab, daclizumab, etaracizumab, milatuzumab, ozanezumab, pinatuzumab vedotin, polatuzumab vedotin, tigatuzumab, veltuzumab, abituzumab, bococizumab, demcizumab, gevokizumab, ponezumab, ralpancizumab, romosozumab, tanezumab, blosozumab, concizumab, crenezumab, ibalizumab, ixekizumab, lebrikizumab, olokizumab, pembrolizumab, simtuzumab, ulocuplumab, vatelizumab, and samalizumab (see, e.g., SEQ ID NOs: 358-432). Any of the Fc modifications known in the art may be applied to the CB1 receptor antibodies provided herein to alter effector function, antibody half life, or other antibody properties.

In one embodiment, the CB1 antibody exhibits reduced effector function. In a further embodiment, the CB1 antibody comprises an IgG4 Fc region having a mutation at position 228. In a further embodiment, the amino acid at position 228 is mutated from serine (S) to proline (P) (i.e., S228P). In another embodiment, the CB1 antibody exhibits reduced effector function and comprises an IgG2 Fc region having a mutation at position 330 and/or 331. In a further embodiment, the amino acid at position 330 is mutated from alanine (A) to serine (S), and/or the amino acid at position 331 is mutated from proline (P) to serine (S). In a further embodiment, the CB1 antibody comprises an IgG2 Fc domain having both A330S and P331S mutations. In another embodiment, the CB1 antibody comprises an IgG2/IgG4 hybrid Fc region. For example, in one embodiment, the CB1 antibody comprises a CH1 and hinge region derived from IgG2, and a CH2 and CH3 region derived from IgG4.

Conformation Antigen Presenting System (iCAPS). iCAPS enable the purified, isolated, conformationally correct presentation of functional GPCRs. Purified GPCRs are stabilized in lipid bilayers surrounded by a belt protein.

In one embodiment, the invention provides an isolated nucleic acid encoding any one of the antibodies and antigen binding fragments or variants thereof disclosed herein. In some embodiments, a vector comprising the isolated nucleic acid is provided. In some embodiments, a host cell transformed with the vector is provided. In some embodiments, the host cell is a prokaryotic cell. In further embodiments, the host cell is *Escherichia coli*. In some embodiments, the host cell is a eukaryotic cell. In further embodiments, the eukaryotic cell is selected from the group consisting of protist cell, animal cell, plant cell and fungal cell. In some embodiments, the host cell is a mammalian cell including, but not limited to, 293, COS, NS0, and CHO and; or a fungal cell such as *Saccharomyces cerevisiae*; or an insect cell such as Sf9. One embodiment of the invention provides methods of producing the antibodies and fragments or variants described herein comprising culturing any one of the host cells also herein in a culture medium under conditions sufficient to produce the binding protein.

Exemplary CB1 receptor binding antibodies of the invention are provided below in Table 1. Additional exemplary CB1 receptor binding antibodies of the invention are defined by SEQ ID NO. and provided in the sequence listing as shown in Table 2. Sequences for the exemplary humanized CB1 receptor binding antibodies of the invention are provided in Table 3 and Table 35.

TABLE 1

Nucleic acid and amino acid sequences of heavy chain variable regions and light chain variable regions of exemplary CB1 receptor binding antibodies

| Name | Sequence description | SEQ ID NO | Sequence |
|---|---|---|---|
| PA13R3-P1C4 (chimeric) | Heavy chain (HC) variable region nucleic acid sequence | 1 | GAGGTCCAGCTGCAGCAGTCTGGGGCTGAGCTGGTG AGGCCTGGGGTCTCAGTGAAGATTTCCTGCAAGGCTT CTGGCTATGAATTCAGTTACTACTGGATGAACTGGGT GAAGCAGAGGCCTGGACAGGGTCTTGAGTGGATTGG ACAGATTTATCCTGGAGATGGTGAAACTAAGTACAA TGGAAAGTTCAAGGGTAAAGCCACACTGACTGCAGA CAAATCCTCCAACACAGCCTATATGCAGCTCAGCAG |

TABLE 1-continued

Nucleic acid and amino acid sequences of heavy chain
variable regions and light chain variable regions of
exemplary CB1 receptor binding antibodies

| Name | Sequence description | SEQ ID NO | Sequence |
|---|---|---|---|
| | | | CCTAACATCTGAGGACTCTGCGGTCTATTTCTGTGCA AGATCCCATGGTAACTACCTTCCTTACTGGGGCCAAG GGACTCTGGTCACTGTCTCTGCA |
| | HC variable region amino acid sequence | 2 | EVQLQQSGAELVRPGVSVKISCKASGYEFSYYWMNWV KQRPGQGLEWIGQIYPGDGETKYNGKFKGKATLTADK SSNTAYMQLSSLTSEDSAVYFCARSHGNYLPYWGQGT LVTVSA |
| | HC constant region nucleic acid sequence | 3 | GCCTCCACCAAGGGCCCATCGGTCTTCCCCCTGGCAC CCTCCTCCAAGAGCACCTCTGGGGGCACAGCGGCCC TGGGCTGCCTGGTCAAGGACTACTTCCCCGAACCGGT GACGGTGTCATGGAACTCAGGCGCCCTGACCAGCGG CGTGCACACCTTCCCGGCTGTCCTACAGTCCTCAGGA CTCTACTCCCTCAGCAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCAAAACCCAAGGACACCC TCATGATCTCCCGGACCCCTGAGGTCACATGCGTGGT GGTGGACGTGAGCCACGAAGACCCTGAGGTCAAGTT CAACTGGTACGTGGACGGCGTGGAGGTGCATAATGC CAAGACAAAGCCGCGGGAGGAGCAGTACAACAGCA CGTACCGTGTGGTCAGCGTCCTCACCGTCCTGCACCA GGACTGGCTGAATGGCAAGGAGTACAAGTGCAAGGT CTCCAACAAAGCCCTCCCAGCCCCCATCGAGAAAAC CATCTCCAAAGCCAAAGGGCAGCCCCGAGAACCACA GGTGTACACCCTGCCCCCATCCCGGGATGAGCTGAC CAAGAACCAGGTCAGCCTGACCTGCCTGGTCAAAGG CTTCTATCCCAGCGACATCGCCGTGGAGTGGGAGAG CAATGGGCAGCCGGAGAACAACTACAAGACCACGCC TCCCGTGCTGGACTCCGACGGCTCCTTCTTCCTCTAC AGCAAGCTCACCGTGGACAAGAGCAGGTGGCAGCAG GGGAACGTCTTCTCATGCTCCGTGATGCATGAGGCTC TGCACAACCACTACACGCAGAAGAGCCTCTCCCTGT CTCCGGGTAAATGA |
| | HC constant region amino acid sequence | 4 | ASTKGPSVFPLAPSSKSTSGGTAALGCLVKDYFPEPVTV SWNSGALTSGVHTFPAVLQSSGLYSLSSVVTVPSSSLGT QTYICNVNHKPSNTKVDKKVEPKSCDKTHTCPPCPAPE LLGGPSVFLFPPKPKDTLMISRTPEVTCVVVDVSHEDPE VKFNWYVDGVEVHNAKTKPREEQYNSTYRVVSVLTV LHQDWLNGKEYKCKVSNKALPAPIEKTISKAKGQPREP QVYTLPPSRDELTKNQVSLTCLVKGFYPSDIAVEWESN GQPENNYKTTPPVLDSDGSFFLYSKLTVDKSRWQQGN VFSCSVMHEALHNHYTQKSLSLSPGK |
| | Light chain (LC) variable region nucleic acid sequence | 5 | GATATTGTTCTCACCCAGTCTCCAGCAATCATGTCTG CATCTCTAGGGGAACGGGTCACCATGACCTGCACTG CCAGCTCAAGTGTAAGTTCCAGTTACTTGCACTGGTA CCAGCAGAAGCCAGGATCCTCCCCCAAACTCTGGAT TTATAGCACATCCAACCTGGCTTCTGGAGTCCCAGCT CGCTTCAGTGGCAGTGGGTCTGGGACCTCTTACTCTC TCACAATCAGCAGCATGGAGGCTGAAGATGCTGCCA CTTATTACTGCCACCAGTATCATCGTTCCCCACCCAC GTTCGGTGCTGGGACCAAGCTGGAGCTGAAA |
| | LC variable region amino acid sequence | 6 | DIVLTQSPAIMSASLGERVTMTCTASSSVSSSYLHWYQ QKPGSSPKLWIYSTSNLASGVPARFSGSGSGTSYSLTISS MEAEDAATYYCHQYHRSPPTFGAGTKLELK |
| | LC constant region nucleic acid sequence | 7 | CGAACTGTGGCTGCACCATCTGTCTTCATCTTCC CGCCATCTGATGAGCAGTTGAAATCTGGAACTG CCTCTGTTGTGTGCCTGCTGAATAACTTCTATCC CAGAGAGGCCAAAGTACAGTGGAAGGTGGATA ACGCCCTCCAATCGGGTAACTCCCAGGAGAGTG TCACAGAGCAGGACAGCAAGGACAGCACCTACA GCCTCAGCAGCACCCTGACGCTGAGCAAAGCAG ACTACGAGAAACACAAAGTCTACGCCTGCGAAG TCACCCATCAGGGCCTGAGCTTGCCCGTCACAA AGAGCTTCAACAGGGGAGAGTGTTAA |
| | LC constant region amino acid sequence | 8 | RTVAAPSVFIFPPSDEQLKSGTASVVCLLNNFYPRE AKVQWKVDNALQSGNSQESVTEQDSKDSTYSLSS TLTLSKADYEKHKVYACEVTHQGLSLPVTKSFNR GEC |

TABLE 1-continued

Nucleic acid and amino acid sequences of heavy chain
variable regions and light chain variable regions of
exemplary CB1 receptor binding antibodies

| Name | Sequence description | SEQ ID NO | Sequence |
|---|---|---|---|
| 36E12B6 C2 (chimeric) | Heavy chain (HC) variable region nucleic acid sequence | 9 | CAGGTTCAGCTGCAGCAGTCTGGGGCTGAGCTGGTG AGGCCTGGGTCCTCAGTGAAGATTTCCTGCAAGGCTT CTGGCTATGAATTCAGTTACTACTGGATGAACTGGGT GAAGCAGAGGCCTGGACAGGGTCTTCAGTGGATTGG ACAGATTTATCCTGGAGATGGTGATACTAACTACAAT GGAAAGTTCAAGGGTAAAGCCACACTGACTGCAGAC AAATCCTCCAGCACAGCCTACATGCACCTCACCAGC CTAACGTCTGAGGACTCTGCGGTCTATTTCTGTGCAA GATCGGGGGGTAACCCCTTTGCTTTCTGGGGCCAAG GGACTCTGGTCACTGTCTCTGCA |
| | HC variable region amino acid sequence | 10 | QVQLQQSGAELVRPGSSVKISCKASGYEFSYYWMNWV KQRPGQGLQWIGQIYPGDGDTNYNGKFKGKATLTADK SSSTAYMHLTSLTSEDSAVYFCARSGGNPFAFWGQGTL VTVSA |
| | HC constant region nucleic acid sequence | 11 | GCCTCCACCAAGGGCCCATCGGTCTTCCCCCTGGCAC CCTCCTCCAAGAGCACCTCTGGGGGCACAGCGGCCC TGGGCTGCCTGGTCAAGGACTACTTCCCCGAACCGGT GACGGTGTCATGGAACTCAGGCGCCCTGACCAGCGG CGTGCACACCTTCCCGGCTGTCCTACAGTCCTCAGGA CTCTACTCCCTCAGCAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGGT GGTGGACGTGAGCCACGAAGACCCTGAGGTCAAGTT CAACTGGTACGTGGACGGCGTGGAGGTGCATAATGC CAAGACAAAGCCGCGGGAGGAGCAGTACAACAGCA CGTACCGTGTGGTCAGCGTCCTCACCGTCCTGCACCA GGACTGGCTGAATGGCAAGGAGTACAAGTGCAAGGT CTCCAACAAAGCCCTCCCAGCCCCCATCGAGAAAAC CATCTCCAAAGCCAAAGGGCAGCCCCGAGAACCACA GGTGTACACCCTGCCCCCATCCCGGGATGAGCTGAC CAAGAACCAGGTCAGCCTGACCTGCCTGGTCAAAGG CTTCTATCCCAGCGACATCGCCGTGGAGTGGGAGAG CAATGGGCAGCCGGAGAACAACTACAAGACCACGCC TCCCGTGCTGGACTCCGACGGCTCCTTCTTCCTCTAC AGCAAGCTCACCGTGGACAAGAGCAGGTGGCAGCAG GGGAACGTCTTCTCATGCTCCGTGATGCATGAGGCTC TGCACAACCACTACACGCAGAAGAGCCTCTCCCTGT CTCCGGGTAAATGA |
| | HC constant region amino acid sequence | 12 | ASTKGPSVFPLAPSSKSTSGGTAALGCLVKDYFPEPVTV SWNSGALTSGVHTFPAVLQSSGLYSLSSVVTVPSSSLGT QTYICNVNHKPSNTKVDKKVEPKSCDKTHTCPPCPAPE LLGGPSVFLFPPKPKDTLMISRTPEVTCVVVDVSHEDPE VKFNWYVDGVEVHNAKTKPREEQYNSTYRVVSVLTV LHQDWLNGKEYKCKVSNKALPAPIEKTISKAKGQPREP QVYTLPPSRDELTKNQVSLTCLVKGFYPSDIAVEWESN GQPENNYKTTPPVLDSDGSFFLYSKLTVDKSRWQQGN VFSCSVMHEALHNHYTQKSLSLSPGK |
| | Light chain (LC) variable region nucleic acid sequence | 13 | GATATCCAGATGACACAGACTTCATCCTCCCTGTCTG CCTCTCTGGGAGACAGAGTCACCTTCAGTTGCAGGG CAAGTCAGGACATTAGCAATTATTTAAACTGGTATCA GCAGAAACCAGATGGAACTGTTAAACTCCTGATCTA CTACACATCAAGATTACACTCAGGAGTCACATCAAG GTTCCGTGGCAGTGGGTCTGGAACAGATTATTCTCTC ACCATTAGCAACCTGGAGCAAGAAGACGTTGCCACT TACTTTTGCCAACAGGGTCATACGCTTCCGTGGTCGT TCGGTGGAGGCACCAAGCTGGAAATCAAA |
| | LC variable region amino acid sequence | 14 | DIQMTQTSSSLSASLGDRVTFSCRASQDISNYLNWYQQ KPDGTVKLLIYYTSRLHSGVTSRFRGSGSGTDYSLTISN LEQEDVATYFCQQGHTLPWSFGGGTKLEIK |
| | LC constant region nucleic acid sequence | 15 | CGTACGGTGGCTGCACCATCTGTCTTCATCTTCCCGC CATCTGATGAGCAGTTGAAATCTGGAACTGCCTCTGT TGTGTGCCTGCTGAATAACTTCTATCCCAGAGAGGCC AAAGTACAGTGGAAGGTGGATAACGCCCTCCAATCG GGTAACTCCCAGGAGAGTGTCACAGAGCAGGACAGC AAGGACAGCACCTACAGCCTCAGCAGCACCCTGACG CTGAGCAAAGCAGACTACGAGAAACACAAAGTCTAC GCCTGCGAAGTCACCCATCAGGGCCTGAGCTCGCCC GTCACAAAGAGCTTCAACAGGGGAGAGTGTTAG |

TABLE 1-continued

Nucleic acid and amino acid sequences of heavy chain variable regions and light chain variable regions of exemplary CB1 receptor binding antibodies

| Name | Sequence description | SEQ ID NO | Sequence |
|---|---|---|---|
| | LC constant region amino acid sequence | 16 | RTVAAPSVFIFPPSDEQLKSGTASVVCLLNNFYPREAKV QWKVDNALQSGNSQESVTEQDSKDSTYSLSSTLTLSKA DYEKHKVYACEVTHQGLSSPVTKSFNRGEC |
| 36E12B6 C2 (mouse) | Heavy chain (HC) variable region nucleic acid sequence | 17 | CAGGTTCAGCTGCAGCAGTCTGGGGCTGAGCTGGTG AGGCCTGGGTCCTCAGTGAAGATTTCCTGCAAGGCTT CTGGCTATGAATTCAGTTACTACTGGATGAACTGGGT GAAGCAGAGGCCTGGACAGGGTCTTCAGTGGATTGG ACAGATTTATCCTGGAGATGGTGATACTAACTACAAT GGAAAGTTCAAGGGTAAAGCCACACTGACTGCAGAC AAATCCTCCAGCACAGCCTACATGCACCTCACCAGC CTAACGTCTGAGGACTCTGCGGTCTATTTCTGTGCAA GATCGGGGGGTAACCCCTTTGCTTTCTGGGGCCAAG GGACTCTGGTCACTGTCTCTGCA |
| | HC variable region amino acid sequence | 18 | QVQLQQSGAELVRPGSSVKISCKASGYEFSYYWMNWV KQRPGQGLQWIGQIYPGDGDTNYNGKFKGKATLTADK SSSTAYMHLTSLTSEDSAVYFCARSGGNPFAFWGQGTL VTVSA |
| | HC constant region nucleic acid sequence | 19 | GCTAAAACAACAGCCCCATCGGTCTATCCACTGGCC CCTGTGTGTGGAGATACAACTGGCTCCTCGGTGACTC TAGGATGCCTGGTCAAGGGTTATTTCCCTGAGCCAGT GACCTTGACCTGGAACTCTGGATCCCTGTCCAGTGGT GTGCACACCTTCCCAGCTGTCCTGCAGTCTGACCTCT ACACCCTCAGCAGCTCAGTGACTGTAACCTCGAGCA CCTGGCCCAGCCAGTCCATCACCTGCAATGTGGCCCA CCCGGCAAGCAGCACCAAGGTGGACAAGAAAATTGA GCCCAGAGGGCCCACAATCAAGCCCTGTCCTCCATG CAAATGCCCAGCACCTAACCTCTTGGGTGGACCATCC GTCTTCATCTTCCCTCCAAAGATCAAGGATGTACTCA TGATCTCCCTGAGCCCCATAGTCACATGTGTGGTGGT GGATGTGAGCGAGGATGACCCAGATGTCCAGATCAG CTGGTTTGTGAACAACGTGGAAGTACACACAGCTCA GACACAAACCCATAGAGAGGATTACAACAGTACTCT CCGGGTGGTCAGTGCCCTCCCCATCCAGCACCAGGA CTGGATGAGTGGCAAGGAGTTCAAATGCAAGGTCAA CAACAAAGACCTCCCAGCGCCCATCGAGAGAACCAT CTCAAAACCCAAAGGGTCAGTAAGAGCTCCACAGGT ATATGTCTTGCCTCCACCAGAAGAAGAGATGACTAA GAAACAGGTCACTCTGACCTGCATGGTCACAGACTT CATGCCTGAAGACATTTACGTGGAGTGGACCAACAA CGGGAAAACAGAGCTAAACTACAAGAACACTGAACC AGTCCTGGACTCTGATGGTTCTTACTTCATGTACAGC AAGCTGAGAGTGGAAAAGAAGAACTGGGTGGAAAG AAATAGCTACTCCTGTTCAGTGGTCCACGAGGGTCTG CACAATCACCACACGACTAAGAGCTTCTCCCGGACT CCGGGTAAATGA |
| | HC constant region amino acid sequence | 20 | AKTTAPSVYPLAPVCGDTTGSSVTLGCLVKGYFPEPVT LTWNSGSLSSGVHTFPAVLQSDLYTLSSSVTVTSSTWPS QSITCNVAHPASSTKVDKKIEPRGPTIKPCPPCKPAPNL LGGPSVFIFPPKIKDVLMISLSPIVTCVVVDVSEDDPDVQ ISWFVNNVEVHTAQTQTHREDYNSTLRVVSALPIQHQD WMSGKEFKCKVNNKDLPAPIERTISKPKGSVRAPQVYV LPPPEEEMTKKQVTLTCMVTDFMPEDIYVEWTNNGKT ELNYKNTEPVLDSDGSYFMYSKLRVEKKNWVERNSYS CSVVHEGLHNHHTTKSFSRTPGK |
| | Light chain (LC) variable region nucleic acid sequence | 21 | GATATCCAGATGACACAGACTTCATCCTCCCTGTCTG CCTCTCTGGGAGACAGAGTCACCTTCAGTTGCAGGG CAAGTCAGGACATTAGCAATTATTTAAACTGGTATCA GCAGAAACCAGATGGAACTGTTAAACTCCTGATCTA CTACACATCAAGATTACACTCAGGAGTCACATCAAG GTTCCGTGGCAGTGGGTCTGGAACAGATTATTCTCTC ACCATTAGCAACCTGGAGCAAGAAGACGTTGCCACT TACTTTTGCCAACAGGGTCATCGCTTCCGTGGTCGT TCGGTGGAGGCACCAAGCTGGAAATCAAA |
| | LC variable region amino acid sequence | 22 | DIQMTQTSSSLSASLGDRVTFSCRASQDISNYLNWYQQ KPDGTVKLLIYYTSRLHSGVTSRFRGSGSGTDYSLTISN LEQEDVATYFCQQGHTLPWSFGGGTKLEIK |
| | LC constant region nucleic acid sequence | 23 | CGGGCAGATGCTGCACCAACTGTATCCATCTTCCCAC CATCCAGTGAGCAGTTAACATCTGGAGGTGCCTCAG TCGTGTGCTTCTTGAACAACTTCTACCCCAAAGACAT CAATGTCAAGTGGAAGATTGATGGCAGTGAACGACA |

TABLE 1-continued

Nucleic acid and amino acid sequences of heavy chain variable regions and light chain variable regions of exemplary CB1 receptor binding antibodies

| Name | Sequence description | SEQ ID NO | Sequence |
|---|---|---|---|
| | | | AAATGGCGTCCTGAACAGTTGGACTGATCAGGACAG<br>CAAAGACAGCACCTACAGCATGAGCAGCACCCTCAC<br>GTTGACCAAGGACGAGTATGAACGACATAACAGCTA<br>TACCTGTGAGGCCACTCACAAGACATCAACTTCACCC<br>ATTGTCAAGAGCTTCAACAGGAATGAGTGTTAG |
| | LC constant region amino acid sequence | 24 | RADAAPTVSIFPPSSEQLTSGGASVVCFLNNFYPKDINV<br>KWKIDGSERQNGVLNSWTDQDSKDSTYSMSSTLTLTK<br>DEYERHNSYTCEATHKTSTSPIVKSFNRNEC |
| PA2LR3-<br>P4B5<br>(chimeric) | Heavy chain (HC) variable region nucleic acid sequence | 25 | GAGGTTCAGCTGCAGCAGTCTGGGGCTGAACTGGTG<br>AGGCCTGGGTCCTCAGTGAAGATTTCCTGCAAGGCTT<br>CTGGCTATGCATTCAGTTATTACTGGATGAACTGGGT<br>GAAGCAGAGGCCTGGACAGGGTCTTGAGTGGATTGG<br>ACAGATTTATCCTGGAGATGGTGATACTAACTACAGT<br>GGAAGGTTCAAGGGTAAAGCCACACTGACTGCAGAC<br>AAATCCTCCAGCACAGCCTACATTCAGCTCAGCAGC<br>CTAACATCTGAGGACTCTGCGGTCTATTTCTGTGCAA<br>GATCGCACGGTAACTATTTTCCTTACTGGGGCCAAGG<br>GACTCTGGTCACTGTCTCTGCA |
| | HC variable region amino acid sequence | 26 | EVQLQQSGAELVRPGSSVKISCKASGYAFSYYWMNWV<br>KQRPGQGLEWIGQIYPGDGDTNYSGRFKGKATLTADK<br>SSSTAYIQLSSLTSEDSAVYFCARSHGNYFPYWGQGTL<br>VTVSA |
| | HC constant region nucleic acid sequence | 27 | GCCTCCACCAAGGGCCCATCGGTCTTCCCCCTGGCAC<br>CCTCCTCCAAGAGCACCTCTGGGGGCACAGCGGCCC<br>TGGGCTGCCTGGTCAAGGACTACTTCCCCGAACCGGT<br>GACGGTGTCATGGAACTCAGGCGCCCTGACCAGCGG<br>CGTGCACACCTTCCCGGCTGTCCTACAGTCCTCAGGA<br>CTCTACTCCCTCAGCAGCGTGGTGACCGTGCCCTCCA<br>GCAGCTTGGGCACCCAGACCTACATCTGCAACGTGA<br>ATCACAAGCCCAGCAACACCAAGGTGGACAAGAAA<br>GTTGAGCCCAAATCTTGTGACAAAACTCACACATGC<br>CCACCGTGCCCAGCACCTGAACTCCTGGGGGGACCG<br>TCAGTCTTCCTCTTCCCCCCAAAACCCAAGGACACCC<br>TCATGATCTCCCGGACCCCTGAGGTCACATGCGTGGT<br>GGTGGACGTGAGCCACGAAGACCCTGAGGTCAAGTT<br>CAACTGGTACGTGGACGGCGTGGAGGTGCATAATGC<br>CAAGACAAAGCCGCGGGAGGAGCAGTACAACAGCA<br>CGTACCGTGTGGTCAGCGTCCTCACCGTCCTGCACCA<br>GGACTGGCTGAATGGCAAGGAGTACAAGTGCAAGGT<br>CTCCAACAAAGCCCTCCCAGCCCCCATCGAGAAAAC<br>CATCTCCAAAGCCAAAGGGCAGCCCCGAGAACCACA<br>GGTGTACACCCTGCCCCCATCCCGGGATGAGCTGAC<br>CAAGAACCAGGTCAGCCTGACCTGCCTGGTCAAAGG<br>CTTCTATCCCAGCGACATCGCCGTGGAGTGGGAGAG<br>CAATGGGCAGCCGGAGAACAACTACAAGACCACGCC<br>TCCCGTGCTGGACTCCGACGGCTCCTTCTTCCTCTAC<br>AGCAAGCTCACCGTGGACAAGAGCAGGTGGCAGCAG<br>GGGAACGTCTTCTCATGCTCCGTGATGCATGAGGCTC<br>TGCACAACCACTACACGCAGAAGAGCCTCTCCCTGT<br>CTCCGGGTAAATGA |
| | HC constant region amino acid sequence | 28 | ASTKGPSVFPLAPSSKSTSGGTAALGCLVKDYFPEPVTV<br>SWNSGALTSGVHTFPAVLQSSGLYSLSSVVTVPSSSLGT<br>QTYICNVNHKPSNTKVDKKVEPKSCDKTHTCPPCPAPE<br>LLGGPSVFLFPPKPKDTLMISRTPEVTCVVVDVSHEDPE<br>VKFNWYVDGVEVHNAKTKPREEQYNSTYRVVSVLTV<br>LHQDWLNGKEYKCKVSNKALPAPIEKTISKAKGQPREP<br>QVYTLPPSRDELTKNQVSLTCLVKGFYPSDIAVEWESN<br>GQPENNYKTTPPVLDSDGSFFLYSKLTVDKSRWQQGN<br>VFSCSVMHEALHNHYTQKSLSLSPGK |
| | Light chain (LC) variable region nucleic acid sequence | 29 | GACATTGTTCTCAACCAGTCTCCAGCAATCATGTCTG<br>CATCTCTAGGGGAACGGGTCACCATGACCTGCACTG<br>CCAGCTCAAGTGTAAGTTCCAGTTACTTGCACTGGTA<br>CCAGCAGAAGCCAGGATCCTCCCCCAAACTCTGGAT<br>TTATAGCACATCCAACCTGGCTTCTGGAGTCCCAGCT<br>CGCTTCAGTGGCAGTGGGTCTGGGACCTCTTACTCTC<br>TCACAATCAGCAGCATGGAGGCTGAAGATGCTGCCA<br>CTTATTACTGCCACCAGTATCATCGTTCCCCGCTCAC<br>GTTCGGTGCTGGGACCAAACTGGAAATAAAA |

TABLE 1-continued

Nucleic acid and amino acid sequences of heavy chain variable regions and light chain variable regions of exemplary CB1 receptor binding antibodies

| Name | Sequence description | SEQ ID NO | Sequence |
|---|---|---|---|
| | LC variable region amino acid sequence | 30 | DIVLNQSPAIMSASLGERVTMTCTASSSVSSSYLHWYQ QKPGSSPKLWIYSTSNLASGVPARFSGSGSGTSYSLTISS MEAEDAATYYCHQYHRSPLTFGAGTKLEIK |
| | LC constant region nucleic acid sequence | 31 | CGAACTGTGGCTGCACCATCTGTCTTCATCTTCC CGCCATCTGATGAGCAGTTGAAATCTGGAACTG CCTCTGTTGTGTGCCTGCTGAATAACTTCTATCC CAGAGAGGCCAAAGTACAGTGGAAGGTGGATA ACGCCCTCCAATCGGGTAACTCCCAGGAGAGTG TCACAGAGCAGGACAGCAAGGACAGCACCTACA GCCTCAGCAGCACCCTGACGCTGAGCAAAGCAG ACTACGAGAAACACAAAGTCTACGCCTGCGAAG TCACCCATCAGGGCCTGAGCTTGCCCGTCACAA AGAGCTTCAACAGGGGAGAGTGTTAA |
| | LC constant region amino acid sequence | 32 | RTVAAPSVFIFPPSDEQLKSGTASVVCLLNNFYPRE AKVQWKVDNALQSGNSQESVTEQDSKDSTYSLSS TLTLSKADYEKHKVYACEVTHQGLSLPVTKSFNR GEC |
| PA2LR3-P2D3 (chimeric) | Heavy chain (HC) variable region nucleic acid sequence | 33 | GAGGTTCAGCTGCAGCAGTCTGGGGCTGAGCTGGTG AGGCCTGGGTCCTCAGTGAAGATTTCCTGCAAGGCTT CTGGCTATGCATTCAGTTACTACTGGATGAACTGGGT GAAGCAGAGGCCTGGACAGGGTCTTGAGTGGATTGG ACAGATTTATCCTGGAGATGGTGATACTAACTACAAT GGAAAGTTCAAGGGTAAAGCCACACTGACTGCAGAC AAATCCTCCAGTACAGCCTACATGCAGCTCAGCAGC CTAACATCTGAGGACTCTGCGGTCTATTTCTGTGCAA GATCGCACGGTAGCTATTTTGCTTACTGGGGCCAAGG GACTCTGGTCACTGTCTCTGCA |
| | HC variable region amino acid sequence | 34 | EVQLQQSGAELVRPGSSVKISCKASGYAFSYYWMNWV KQRPGQGLEWIGQIYPGDGDTNYNGKFKGKATLTADK SSSTAYMQLSSLTSEDSAVYFCARSHGSYFAYWGQGTL VTVSA |
| | HC constant region nucleic acid sequence | 35 | GCCTCCACCAAGGGCCCATCGGTCTTCCCCCTGGCAC CCTCCTCCAAGAGCACCTCTGGGGGCACAGCGGCCC TGGGCTGCCTGGTCAAGGACTACTTCCCCGAACCGGT GACGGTGTCATGGAACTCAGGCGCCCTGACCAGCGG CGTGCACACCTTCCCGGCTGTCCTACAGTCCTCAGGA CTCTACTCCCTCAGCAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGGT GGTGGACGTGAGCCACGAAGACCCTGAGGTCAAGTT CAACTGGTACGTGGACGGCGTGGAGGTGCATAATGC CAAGACAAAGCCGCGGGAGGAGCAGTACAACAGCA CGTACCGTGTGGTCAGCGTCCTCACCGTCCTGCACCA GGACTGGCTGAATGGCAAGGAGTACAAGTGCAAGGT CTCCAACAAAGCCCTCCCAGCCCCCATCGAGAAAAC CATCTCCAAAGCCAAAGGGCAGCCCCGAGAACCACA GGTGTACACCCTGCCCCCATCCCGGGATGAGCTGAC CAAGAACCAGGTCAGCCTGACCTGCCTGGTCAAAGG CTTCTATCCCAGCGACATCGCCGTGGAGTGGGAGAG CAATGGGCAGCCGGAGAACAACTACAAGACCACGCC TCCCGTGCTGGACTCCGACGGCTCCTTCTTCCTCTAC AGCAAGCTCACCGTGGACAAGAGCAGGTGGCAGCAG GGGAACGTCTTCTCATGCTCCGTGATGCATGAGGCTC TGCACAACCACTACACGCAGAAGAGCCTCTCCCTGT CTCCGGGTAAATGA |
| | HC constant region amino acid sequence | 36 | ASTKGPSVFPLAPSSKSTSGGTAALGCLVKDYFPEPVTV SWNSGALTSGVHTFPAVLQSSGLYSLSSVVTVPSSSLGT QTYICNVNHKPSNTKVDKKVEPKSCDKTHTCPPCPAPE LLGGPSVFLFPPKPKDTLMISRTPEVTCVVVDVSHEDPE VKFNWYVDGVEVHNAKTKPREEQYNSTYRVVSVLTV LHQDWLNGKEYKCKVSNKALPAPIEKTISKAKGQPREP QVYTLPPSRDELTKNQVSLTCLVKGFYPSDIAVEWESN GQPENNYKTTPPVLDSDGSFFLYSKLTVDKSRWQQGN VFSCSVMHEALHNHYTQKSLSLSPGK |
| | Light chain (LC) variable | 37 | GATATTGAGCTGGCCCAATCTCCAGCTTCTTTGGCTG TGTCTCTAGGGCAGAGGGCCACCATATCCTGCAGAG CCAGTGAAAGTGTTGATAGTTATGGCAATAGTTTTAT |

TABLE 1-continued

Nucleic acid and amino acid sequences of heavy chain
variable regions and light chain variable regions of
exemplary CB1 receptor binding antibodies

| Name | Sequence description | SEQ ID NO | Sequence |
|---|---|---|---|
| | region nucleic acid sequence | | GCACTGGTACCAGCAGAAACCAGGACAGCCACCCAA ACTCCTCATCTATCTTGCATCCAACCTAGAATCTGGG GTCCCTGCCAGGTTCAGCGGCAGTGGGTCTAGGGCA GACTTCACCCTCACCATTGATCCTGTGGAGGCTGATG ATGCTGCAACCTATTACTGTCTACAATATGCTAGTTC TCCTCCTACGTTCGGTGCTGGGACCAAACTGGAAATA AAA |
| | LC variable region amino acid sequence | 38 | DIELAQSPASLAVSLGQRATISCRASESVDSYGNSFMH WYQQKPGQPPKLLIYLASNLESGVPARFSGSGSRADFT LTIDPVEADDAATYYCLQYASSPPTFGAGTKLEIK |
| | LC constant region nucleic acid sequence | 39 | CGAACTGTGGCTGCACCATCTGTCTTCATCTTCCCGC CATCTGATGAGCAGTTGAAATCTGGAACTGCCTCTGT TGTGTGCCTGCTGAATAACTTCTATCCCAGAGAGGCC AAAGTACAGTGGAAGGTGGATAACGCCCTCCAATCG GGTAACTCCCAGGAGAGTGTCACAGAGCAGGACAGC AAGGACAGCACCTACAGCCTCAGCAGCACCCTGACG CTGAGCAAAGCAGACTACGAGAAACACAAAGTCTAC GCCTGCGAAGTCACCCATCAGGGCCTGAGCTTGCCC GTCACAAAGAGCTTCAACAGGGGAGAGTGTTAA |
| | LC constant region amino acid sequence | 40 | RTVAAPSVFIFPPSDEQLKSGTASVVCLLNNFYPREAKV QWKVDNALQSGNSQESVTEQDSKDSTYSLSSTLTLSKA DYEKHKVYACEVTHQGLSLPVTKSFNRGEC |
| PA2LR3- P4B1 (chimeric) | Heavy chain (HC) variable region nucleic acid sequence | 41 | GAGGTCCAGCTTCAGCAATCTGGGGCTGAGCTGGTG AGGCCTGGGTCCTCAGTGAAGATTTCCTGCAAGGCTT CTGGCTTTGCATTCAGTAACTACTGGATGAACTGGGT GAAGCAGAGGCCTGGACAGGGTCTTGAGTGGATTGG ACAGATTTATCCTGGAGATGGTGATACTAACTTCAAT GGAAAGTTCAAGGGTAGAGCCATACTGACTGCAGAC ATATCCTCCAACACAGCCTACATGCAGCTCAGCAGC CTAACATCTGAGGACTCTGCGGTCTATTTCTGTGCAA GATCGCACGGTAACTATTTTCCTTACTGGGGCCAAGG GACTCTGGTCACTGTCTCTGCA |
| | HC variable region amino acid sequence | 42 | EVQLQQSGAELVRPGSSVKISCKASGFAFSNYWMNWV KQRPGQGLEWIGQIYPGDGDTNFNGKFKGRAILTADISS NTAYMQLSSLTSEDSAVYFCARSHGNYFPYWGQGTLV TVSA |
| | HC constant region nucleic acid sequence | 43 | GCCTCCACCAAGGGCCCATCGGTCTTCCCCCTGGCAC CCTCCTCCAAGAGCACCTCTGGGGGCACAGCGGCCC TGGGCTGCCTGGTCAAGGACTACTTCCCCGAACCGGT GACGGTGTCATGGAACTCAGGCGCCCTGACCAGCGG CGTGCACACCTTCCCGGCTGTCCTACAGTCCTCAGGA CTCTACTCCCTCAGCAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGGT GGTGGACGTGAGCCACGAAGACCCTGAGGTCAAGTT CAACTGGTACGTGGACGGCGTGGAGGTGCATAATGC CAAGACAAAGCCGCGGGAGGAGCAGTACAACAGCA CGTACCGTGTGGTCAGCGTCCTCACCGTCCTGCACCA GGACTGGCTGAATGGCAAGGAGTACAAGTGCAAGGT CTCCAACAAAGCCCTCCCAGCCCCCATCGAGAAAAC CATCTCCAAAGCCAAAGGGCAGCCCCGAGAACCACA GGTGTACACCCTGCCCCCATCCCGGGATGAGCTGAC CAAGAACCAGGTCAGCCTGACCTGCCTGGTCAAAGG CTTCTATCCCAGCGACATCGCCGTGGAGTGGGAGAG CAATGGGCAGCCGGAGAACAACTACAAGACCACGCC TCCCGTGCTGGACTCCGACGGCTCCTTCTTCCTCTAC AGCAAGCTCACCGTGGACAAGAGCAGGTGGCAGCAG GGGAACGTCTTCTCATGCTCCGTGATGCATGAGGCTC TGCACAACCACTACACGCAGAAGAGCCTCTCCCTGT CTCCGGGTAAATGA |
| | HC constant region amino acid sequence | 44 | ASTKGPSVFPLAPSSKSTSGGTAALGCLVKDYFPEPVTV SWNSGALTSGVHTFPAVLQSSGLYSLSSVVTVPSSSLGT QTYICNVNHKPSNTKVDKKVEPKSCDKTHTCPPCPAPE LLGGPSVFLFPPKPKDTLMISRTPEVTCVVVDVSHEDPE VKFNWYVDGVEVHNAKTKPREEQYNSTYRVVSVLTV LHQDWLNGKEYKCKVSNKALPAPIEKTISKAKGQPREP |

TABLE 1-continued

Nucleic acid and amino acid sequences of heavy chain variable regions and light chain variable regions of exemplary CB1 receptor binding antibodies

| Name | Sequence description | SEQ ID NO | Sequence |
|---|---|---|---|
| | | | QVYTLPPSRDELTKNQVSLTCLVKGFYPSDIAVEWESN GQPENNYKTTPPVLDSDGSFFLYSKLTVDKSRWQQGN VFSCSVMHEALHNHYTQKSLSLSPGK |
| | Light chain (LC) variable region nucleic acid sequence | 45 | CAAATTGTGTTGACACAGTCTCCAGCAATCATGTCTG CATCTCTAGGGGAACGGGTCACCATGACCTGCACTG CCAGCTCAAGTGTAAGTTCCAGTTACTTGCACTGGTA CCAGCAGAAGCCAGGATCCTCCCCCAAACTCTGGAT TTATAGCACATCCAACCTGGCTTCTGGAGTCCCAGCT CGCTTCAGTGGCAGTGGGTCTGGGACCTCTTACTCTC TCACAATCAGCAGCATGGAGGCTGAAGATGCTGCCA CTTATTACTGCCACCAGTATCATCGTTCCCCGCTCAC GTTCGGTGCTGGGACCAAGCTGGAGCTGAAA |
| | LC variable region amino acid sequence | 46 | QIVLTQSPAIMSASLGERVTMTCTASSSVSSSYLHWYQ QKPGSSPKLWIYSTSNLASGVPARFSGSGSGTSYSLTISS MEAEDAATYYCHQYHRSPLTFGAGTKLELK |
| | LC constant region nucleic acid sequence | 47 | CGAACTGTGGCTGCACCATCTGTCTTCATCTTCCCGC CATCTGATGAGCAGTTGAAATCTGGAACTGCCTCTGT TGTGTGCCTGCTGAATAACTTCTATCCCAGAGAGGCC AAAGTACAGTGGAAGGTGGATAACGCCCTCCAATCG GGTAACTCCCAGGAGAGTGTCACAGAGCAGGACAGC AAGGACAGCACCTACAGCCTCAGCAGCACCCTGACG CTGAGCAAAGCAGACTACGAGAAACACAAAGTCTAC GCCTGCGAAGTCACCCATCAGGGCCTGAGCTTGCCC GTCACAAAGAGCTTCAACAGGGGAGAGTGTTAA |
| | LC constant region amino acid sequence | 48 | RTVAAPSVFIFPPSDEQLKSGTASVVCLLNNFYPREAKV QWKVDNALQSGNSQESVTEQDSKDSTYSLSSTLTLSKA DYEKHKVYACEVTHQGLSLPVTKSFNRGEC |
| PA2LR3-P6B12 (chimeric) | Heavy chain (HC) variable region nucleic acid sequence | 49 | GAGGTCCAGCTTCAGCAATCTGGGGCTGAGCTGGTG AGGCCTGGGTCCTCAGTGAAGATTTCCTGCAAGGCTT CTGGCTATGCATTCAGTTACTACTGGATGAACTGGGT GAAGCAGAGGCCTGGACAGGGTCTTGAGTGGATTGG ACAGATTTATCCTGGAGATGGTGATACTAACTACAAT GGAAAGTTCAAGGGTAAAGCCACACTGACTGCAGAC AAATCCTCCAGTACAGCCTACATGCAGCTCAGCAGC CTAACATCTGAGGACTCTGCGGTCTATTTCTGTGCAA GATCGCACGGTAACTATTTTGCTTACTGGGGCCAAGG GACTCTGGTCACTGTCTCTGCA |
| | HC variable region amino acid sequence | 50 | EVQLQQSGAELVRPGSSVKISCKASGYAFSYYWMNWV KQRPGQGLEWIGQIYPGDGDTNYNGKFKGKATLTADK SSSTAYMQLSSLTSEDSAVYFCARSHGNYFAYWGQGT LVTVSA |
| | HC constant region nucleic acid sequence | 51 | GCCTCCACCAAGGGCCCATCGGTCTTCCCCCTGGCAC CCTCCTCCAAGAGCACCTCTGGGGGCACAGCGGCCC TGGGCTGCCTGGTCAAGGACTACTTCCCCGAACCGGT GACGGTGTCATGGAACTCAGGCGCCCTGACCAGCGG CGTGCACACCTTCCCGGCTGTCCTACAGTCCTCAGGA CTCTACTCCCTCAGCAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGGT GGTGGACGTGAGCCACGAAGACCCTGAGGTCAAGTT CAACTGGTACGTGGACGGCGTGGAGGTGCATAATGC CAAGACAAAGCCGCGGGAGGAGCAGTACAACAGCA CGTACCGTGTGGTCAGCGTCCTCACCGTCCTGCACCA GGACTGGCTGAATGGCAAGGAGTACAAGTGCAAGGT CTCCAACAAAGCCCTCCCAGCCCCCATCGAGAAAAC CATCTCCAAAGCCAAAGGGCAGCCCCGAGAACCACA GGTGTACACCCTGCCCCCATCCCGGGATGAGCTGAC CAAGAACCAGGTCAGCCTGACCTGCCTGGTCAAAGG CTTCTATCCCAGCGACATCGCCGTGGAGTGGGAGAG CAATGGGCAGCCGGAGAACAACTACAAGACCACGCC TCCCGTGCTGGACTCCGACGGCTCCTTCTTCCTCTAC AGCAAGCTCACCGTGGACAAGAGCAGGTGGCAGCAG GGGAACGTCTTCTCATGCTCCGTGATGCATGAGGCTC TGCACAACCACTACACGCAGAAGAGCCTCTCCCTGT CTCCGGGTAAATGA |

TABLE 1-continued

Nucleic acid and amino acid sequences of heavy chain variable regions and light chain variable regions of exemplary CB1 receptor binding antibodies

| Name | Sequence description | SEQ ID NO | Sequence |
|---|---|---|---|
| | HC constant region amino acid sequence | 52 | ASTKGPSVFPLAPSSKSTSGGTAALGCLVKDYFPEPVTV SWNSGALTSGVHTFPAVLQSSGLYSLSSVVTVPSSSLGT QTYICNVNHKPSNTKVDKKVEPKSCDKTHTCPPCPAPE LLGGPSVFLFPPKPKDTLMISRTPEVTCVVVDVSHEDPE VKFNWYVDGVEVHNAKTKPREEQYNSTYRVVSVLTV LHQDWLNGKEYKCKVSNKALPAPIEKTISKAKGQPREP QVYTLPPSRDELTKNQVSLTCLVKGFYPSDIAVEWESN GQPENNYKTTPPVLDSDGSFFLYSKLTVDKSRWQQGN VFSCSVMHEALHNHYTQKSLSLSPGK |
| | Light chain (LC) variable region nucleic acid sequence | 53 | CAAATTGTACTCACCCAGTCTCCAGCAATCATGTCTG CATCTCTAGGGGAACGGGTCACCATGACCTGCACTG CCAGCTCAAGTGTAAGTTCCAGTTACTTGCACTGGTA CCAGCAGAAGCCAGGATCCTCCCCCAAACTCTGGAT TTATAGCACATCCAACCTGGCTTCTGGAGTCCCAGCT CGCTTCAGTGGCAGTGGGTCTGGGACCTCTTACTCTC TCACAATCAGCAGCATGGAGGCTGAAGATGCTGCCA CTTATTACTGCCACCAGTATCATCGTTCCCCCCTCGC GTTCGGTGCTGGGACCAAGCTGGAGCTGAAA |
| | LC variable region amino acid sequence | 54 | QIVLTQSPAIMSASLGERVTMTCTASSSVSSSYLHWYQ QKPGSSPKLWIYSTSNLASGVPARFSGSGSGTSYSLTISS MEAEDAATYYCHQYHRSPLAFGAGTKLELK |
| | LC constant region nucleic acid sequence | 55 | CGAACTGTGGCTGCACCATCTGTCTTCATCTTCCCGC CATCTGATGAGCAGTTGAAATCTGGAACTGCCTCTGT TGTGTGCCTGCTGAATAACTTCTATCCCAGAGAGGCC AAAGTACAGTGGAAGGTGGATAACGCCCTCCAATCG GGTAACTCCCAGGAGAGTGTCACAGAGCAGGACAGC AAGGACAGCACCTACAGCCTCAGCAGCACCCTGACG CTGAGCAAAGCAGACTACGAGAAACACAAAGTCTAC GCCTGCGAAGTCACCCATCAGGGCCTGAGCTTGCCC GTCACAAAGAGCTTCAACAGGGGAGAGTGTTAA |
| | LC constant region amino acid sequence | 56 | RTVAAPSVFIFPPSDEQLKSGTASVVCLLNNFYPREAKV QWKVDNALQSGNSQESVTEQDSKDSTYSLSSTLTLSKA DYEKHKVYACEVTHQGLSLPVTKSFNRGEC |
| PA2LR3-P6G7 (chimeric) | Heavy chain (HC) variable region nucleic acid sequence | 57 | GAGGTTCAGCTTCAGCAATCTGGGGCTGAGCTGGTG AGGCCTGGGTCCTCAGTGAAGATTTCCTGCAAGGCTT CTGGCTTTGCATTCAGTAACTACTGGATGAACTGGGT GAAGCAGAGGCCCGGACAGGGTCTTGAGTGGATTGG ACAGATTTATCCTGGAGATGGTGATACTAACTTCAAT GGAAAGTTCAAGGGTAGAGCCATACTGACTGCAGAC ATATCCTCCAACACAGCCTACATGCAGCTCAGCAGC CTAACATCTGAGGACTCTGCGGTCTATTTCTGTGCAA GATCGCACGGTAACTATTTTCCTTACTGGGGCCAAGG GACTCTGGTCACTGTCTCTGCA |
| | HC variable region amino acid sequence | 58 | EVQLQQSGAELVRPGSSVKISCKASGFAFSNYWMNWV KQRPGQGLEWIGQIYPGDGDTNFNGKFKGRAILTADISS NTAYMQLSSLTSEDSAVYFCARSHGNYFPYWGQGTLV TVSA |
| | HC constant region nucleic acid sequence | 59 | GCCTCCACCAAGGGCCCATCGGTCTTCCCCCTGGCAC CCTCCTCCAAGAGCACCTCTGGGGGCACAGCGGCCC TGGGCTGCCTGGTCAAGGACTACTTCCCCGAACCGGT GACGGTGTCATGGAACTCAGGCGCCCTGACCAGCGG CGTGCACACCTTCCCGGCTGTCCTACAGTCCTCAGGA CTCTACTCCCTCAGCAGCGTGGTGACCGTGCCCTCCA GCAGCTTGGGCACCCAGACCTACATCTGCAACGTGA ATCACAAGCCCAGCAACACCAAGGTGGACAAGAAA GTTGAGCCCAAATCTTGTGACAAAACTCACACATGC CCACCGTGCCCAGCACCTGAACTCCTGGGGGGACCG TCAGTCTTCCTCTTCCCCCCAAAACCCAAGGACACCC TCATGATCTCCCGGACCCCTGAGGTCACATGCGTGGT GGTGGACGTGAGCCACGAAGACCCTGAGGTCAAGTT CAACTGGTACGTGGACGGCGTGGAGGTGCATAATGC CAAGACAAAGCCGCGGGAGGAGCAGTACAACAGCA CGTACCGTGTGGTCAGCGTCCTCACCGTCCTGCACCA GGACTGGCTGAATGGCAAGGAGTACAAGTGCAAGGT CTCCAACAAAGCCCTCCCAGCCCCCATCGAGAAAAC CATCTCCAAAGCCAAAGGGCAGCCCCGAGAACCACA GGTGTACACCCTGCCCCCATCCCGGGATGAGCTGAC CAAGAACCAGGTCAGCCTGACCTGCCTGGTCAAAGG CTTCTATCCCAGCGACATCGCCGTGGAGTGGGAGAG CAATGGGCAGCCGGAGAACAACTACAAGACCACGCC |

TABLE 1-continued

Nucleic acid and amino acid sequences of heavy chain
variable regions and light chain variable regions of
exemplary CB1 receptor binding antibodies

| Name | Sequence description | SEQ ID NO | Sequence |
|---|---|---|---|
| | | | TCCCGTGCTGGACTCCGACGGCTCCTTCTTCCTCTAC<br>AGCAAGCTCACCGTGGACAAGAGCAGGTGGCAGCAG<br>GGGAACGTCTTCTCATGCTCCGTGATGCATGAGGCTC<br>TGCACAACCACTACACGCAGAAGAGCCTCTCCCTGT<br>CTCCGGGTAAATGA |
| | HC constant region amino acid sequence | 60 | ASTKGPSVFPLAPSSKSTSGGTAALGCLVKDYFPEPVTV<br>SWNSGALTSGVHTFPAVLQSSGLYSLSSVVTVPSSSLGT<br>QTYICNVNHKPSNTKVDKKVEPKSCDKTHTCPPCPAPE<br>LLGGPSVFLFPPKPKDTLMISRTPEVTCVVVDVSHEDPE<br>VKFNWYVDGVEVHNAKTKPREEQYNSTYRVVSVLTV<br>LHQDWLNGKEYKCKVSNKALPAPIEKTISKAKGQPREP<br>QVYTLPPSRDELTKNQVSLTCLVKGFYPSDIAVEWESN<br>GQPENNYKTTPPVLDSDGSFFLYSKLTVDKSRWQQGN<br>VFSCSVMHEALHNHYTQKSLSLSPGK |
| | Light chain (LC) variable region nucleic acid sequence | 61 | GATATTGTGCTAACTCAGTCTCCAGCAATCATGTCCG<br>CATCTCTAGGGGAACGGGTCACCATGACCTGCACTG<br>CCAGCTCAAGTGTAAGTTCCAGTTACTTACACTGGTA<br>CCAGCAGAAGCCAGGATCCTCCCCCAAACTCTGGAT<br>TTATAGCACCTCCAACCTGGCTTCTGGAGTCCCAGCT<br>CGCTTCAGTGGCAGTGGGTCTGGGACCTCTTACTCTC<br>TCACAATCAGCAGCATGGAGGCTGAAGATGCTGCCA<br>CTTATTACTGCCACCAGCATCATCGTTCCCCACCCAC<br>GTTCGGTGCTGGGACCAAGCTGGAGCTGAAA |
| | LC variable region amino acid sequence | 62 | DIVLTQSPAIMSASLGERVTMTCTASSSVSSSYLHWYQ<br>QKPGSSPKLWIYSTSNLASGVPARFSGSGSGTSYSLTISS<br>MEAEDAATYYCHQHHRSPPTFGAGTKLELK |
| | LC constant region nucleic acid sequence | 63 | CGAACTGTGGCTGCACCATCTGTCTTCATCTTCCCGC<br>CATCTGATGAGCAGTTGAAATCTGGAACTGCCTCTGT<br>TGTGTGCCTGCTGAATAACTTCTATCCCAGAGAGGCC<br>AAAGTACAGTGGAAGGTGGATAACGCCCTCCAATCG<br>GGTAACTCCCAGGAGAGTGTCACAGAGCAGGACAGC<br>AAGGACAGCACCTACAGCCTCAGCAGCACCCTGACG<br>CTGAGCAAAGCAGACTACGAGAAACACAAAGTCTAC<br>GCCTGCGAAGTCACCCATCAGGGCCTGAGCTTGCCC<br>GTCACAAAGAGCTTCAACAGGGGAGAGTGTTAA |
| | LC constant region amino acid sequence | 64 | RTVAAPSVFIFPPSDEQLKSGTASVVCLLNNFYPREAKV<br>QWKVDNALQSGNSQESVTEQDSKDSTYSLSSTLTLSKA<br>DYEKHKVYACEVTHQGLSLPVTKSFNRGEC |

TABLE 2

SEQ ID NOs for additional CB1 receptor binding antibodies

| Name | Sequence description | SEQ ID NO |
|---|---|---|
| PA2LR3-P1G6 (chimeric) | Heavy chain (HC) variable nucleic acid | 65 |
| | HC variable region amino acid | 66 |
| | HC constant region nucleic acid | 67 |
| | HC constant region amino acid | 68 |
| | Light chain (LC) variable region nucleic acid | 69 |
| | LC variable region amino acid | 70 |
| | LC constant region nucleic acid | 71 |
| | LC constant region amino acid | 72 |
| PA2LR3-P1H4 (chimeric) | Heavy chain (HC) variable nucleic acid | 73 |
| | HC variable region amino acid | 74 |
| | HC constant region nucleic acid | 75 |
| | HC constant region amino acid | 76 |
| | Light chain (LC) variable region nucleic acid | 77 |
| | LC variable region amino acid | 78 |
| | LC constant region nucleic acid | 79 |
| | LC constant region amino acid | 80 |
| PA2LR3-P2B8 (chimeric) | Heavy chain (HC) variable nucleic acid | 81 |
| | HC variable region amino acid | 82 |
| | HC constant region nucleic acid | 83 |
| | HC constant region amino acid | 84 |
| | Light chain (LC) variable region nucleic acid | 85 |
| | LC variable region amino acid | 86 |
| | LC constant region nucleic acid | 87 |
| | LC constant region amino acid | 88 |
| PA2LR3-P2E5 (chimeric) | Heavy chain (HC) variable nucleic acid | 89 |
| | HC variable region amino acid | 90 |
| | HC constant region nucleic acid | 91 |
| | HC constant region amino acid | 92 |
| | Light chain (LC) variable region nucleic acid | 93 |
| | LC variable region amino acid | 94 |
| | LC constant region nucleic acid | 95 |
| | LC constant region amino acid | 96 |
| PA2LR3-P3A8 (chimeric) | Heavy chain (HC) variable nucleic acid | 97 |
| | HC variable region amino acid | 98 |
| | HC constant region nucleic acid | 99 |

TABLE 2-continued

SEQ ID NOs for additional CB1 receptor binding antibodies

| Name | Sequence description | SEQ ID NO |
|---|---|---|
| | HC constant region amino acid | 100 |
| | Light chain (LC) variable region nucleic acid | 101 |
| | LC variable region amino acid | 102 |
| | LC constant region nucleic acid | 103 |
| | LC constant region amino acid | 104 |
| PA2LR3-P3B10 (chimeric) | Heavy chain (HC) variable nucleic acid | 105 |
| | HC variable region amino acid | 106 |
| | HC constant region nucleic acid | 107 |
| | HC constant region amino acid | 108 |
| | Light chain (LC) variable region nucleic acid | 109 |
| | LC variable region amino acid | 110 |
| | LC constant region nucleic acid | 111 |
| | LC constant region amino acid | 112 |
| PA2LR3-P3B8 (chimeric) | Heavy chain (HC) variable nucleic acid | 113 |
| | HC variable region amino acid | 114 |
| | HC constant region nucleic acid | 115 |
| | HC constant region amino acid | 116 |
| | Light chain (LC) variable region nucleic acid | 117 |
| | LC variable region amino acid | 118 |
| | LC constant region nucleic acid | 119 |
| | LC constant region amino acid | 120 |
| PA2LR3-P3F8 (chimeric) | Heavy chain (HC) variable nucleic acid | 121 |
| | HC variable region amino acid | 122 |
| | HC constant region nucleic acid | 123 |
| | HC constant region amino acid | 124 |
| | Light chain (LC) variable region nucleic acid | 125 |
| | LC variable region amino acid | 126 |
| | LC constant region nucleic acid | 127 |
| | LC constant region amino acid | 128 |
| PA2LR3-P4C6 (chimeric) | Heavy chain (HC) variable nucleic acid | 129 |
| | HC variable region amino acid | 130 |
| | HC constant region nucleic acid | 131 |
| | HC constant region amino acid | 132 |
| | Light chain (LC) variable region nucleic acid | 133 |
| | LC variable region amino acid | 134 |
| | LC constant region nucleic acid | 135 |
| | LC constant region amino acid | 136 |
| PA2LR3-P4G10 (chimeric) | Heavy chain (HC) variable nucleic acid | 137 |
| | HC variable region amino acid | 138 |
| | HC constant region nucleic acid | 139 |
| | HC constant region amino acid | 140 |
| | Light chain (LC) variable region nucleic acid | 141 |
| | LC variable region amino acid | 142 |
| | LC constant region nucleic acid | 143 |
| | LC constant region amino acid | 144 |
| PA2LR3-P5E7 (chimeric) | Heavy chain (HC) variable nucleic acid | 145 |
| | HC variable region amino acid | 146 |
| | HC constant region nucleic acid | 147 |
| | HC constant region amino acid | 148 |
| | Light chain (LC) variable region nucleic acid | 149 |
| | LC variable region amino acid | 150 |
| | LC constant region nucleic acid | 151 |
| | LC constant region amino acid | 152 |
| PA2LR3-P6D7 (chimeric) | Heavy chain (HC) variable nucleic acid | 153 |
| | HC variable region amino acid | 154 |
| | HC constant region nucleic acid | 155 |
| | HC constant region amino acid | 156 |
| | Light chain (LC) variable region nucleic acid | 157 |
| | LC variable region amino acid | 158 |
| | LC constant region nucleic acid | 159 |
| | LC constant region amino acid | 160 |
| PA2R3-P1A7 (chimeric) | Heavy chain (HC) variable nucleic acid | 161 |
| | HC variable region amino acid | 162 |
| | HC constant region nucleic acid | 163 |
| | HC constant region amino acid | 164 |
| | Light chain (LC) variable region nucleic acid | 165 |
| | LC variable region amino acid | 166 |
| | LC constant region nucleic acid | 167 |
| | LC constant region amino acid | 168 |
| PA2R3-P1F1 (chimeric) | Heavy chain (HC) variable nucleic acid | 169 |
| | HC variable region amino acid | 170 |
| | HC constant region nucleic acid | 171 |
| | HC constant region amino acid | 172 |
| | Light chain (LC) variable region nucleic acid | 173 |
| | LC variable region amino acid | 174 |
| | LC constant region nucleic acid | 175 |
| | LC constant region amino acid | 176 |
| PA13R3-P3A7 (chimeric) | Heavy chain (HC) variable nucleic acid | 177 |
| | HC variable region amino acid | 178 |
| | HC constant region nucleic acid | 179 |
| | HC constant region amino acid | 180 |
| | Light chain (LC) variable region nucleic acid | 181 |
| | LC variable region amino acid | 182 |
| | LC constant region nucleic acid | 183 |
| | LC constant region amino acid | 184 |
| PA13R3-P3C3 (chimeric) | Heavy chain (HC) variable nucleic acid | 185 |
| | HC variable region amino acid | 186 |
| | HC constant region nucleic acid | 187 |
| | HC constant region amino acid | 188 |
| | Light chain (LC) variable region nucleic acid | 189 |
| | LC variable region amino acid | 190 |
| | LC constant region nucleic acid | 191 |
| | LC constant region amino acid | 192 |
| PA13R3-P3D10 (chimeric) | Heavy chain (HC) variable nucleic acid | 193 |
| | HC variable region amino acid | 194 |
| | HC constant region nucleic acid | 195 |
| | HC constant region amino acid | 196 |
| | Light chain (LC) variable region nucleic acid | 197 |
| | LC variable region amino acid | 198 |
| | LC constant region nucleic acid | 199 |
| | LC constant region amino acid | 200 |
| PA13R3-P3D11 (chimeric) | Heavy chain (HC) variable nucleic acid | 201 |
| | HC variable region amino acid | 202 |
| | HC constant region nucleic acid | 203 |
| | HC constant region amino acid | 204 |
| | Light chain (LC) variable region nucleic acid | 205 |
| | LC variable region amino acid | 206 |
| | LC constant region nucleic acid | 207 |
| | LC constant region amino acid | 208 |
| PA13R3-P3F6 (chimeric) | Heavy chain (HC) variable nucleic acid | 209 |
| | HC variable region amino acid | 210 |
| | HC constant region nucleic acid | 211 |
| | HC constant region amino acid | 212 |
| | Light chain (LC) variable region nucleic acid | 213 |
| | LC variable region amino acid | 214 |
| | LC constant region nucleic acid | 215 |
| | LC constant region amino acid | 216 |
| PA13R3-P4C4 (chimeric) | Heavy chain (HC) variable nucleic acid | 217 |
| | HC variable region amino acid | 218 |

TABLE 2-continued

SEQ ID NOs for additional CB1 receptor binding antibodies

| Name | Sequence description | SEQ ID NO |
|---|---|---|
| | HC constant region nucleic acid | 219 |
| | HC constant region amino acid | 220 |
| | Light chain (LC) variable region nucleic acid | 221 |
| | LC variable region amino acid | 222 |
| | LC constant region nucleic acid | 223 |
| | LC constant region amino acid | 224 |
| PA13R3-P4F8 (chimeric) | Heavy chain (HC) variable nucleic acid | 225 |
| | HC variable region amino acid | 226 |
| | HC constant region nucleic acid | 227 |
| | HC constant region amino acid | 228 |
| | Light chain (LC) variable region nucleic acid | 229 |
| | LC variable region amino acid | 230 |
| | LC constant region nucleic acid | 231 |
| | LC constant region amino acid | 232 |
| PA13R3-P4G11 (chimeric) | Heavy chain (HC) variable nucleic acid | 233 |
| | HC variable region amino acid | 234 |
| | HC constant region nucleic acid | 235 |
| | HC constant region amino acid | 236 |
| | Light chain (LC) variable region nucleic acid | 237 |
| | LC variable region amino acid | 238 |
| | LC constant region nucleic acid | 239 |
| | LC constant region amino acid | 240 |
| PA13R3-P4H10 (chimeric) | Heavy chain (HC) variable nucleic acid | 241 |
| | HC variable region amino acid | 242 |
| | HC constant region nucleic acid | 243 |
| | HC constant region amino acid | 244 |
| | Light chain (LC) variable region nucleic acid | 245 |
| | LC variable region amino acid | 246 |
| | LC constant region nucleic acid | 247 |
| | LC constant region amino acid | 248 |
| PA15R3-P3A6 (chimeric) | Heavy chain (HC) variable nucleic acid | 249 |
| | HC variable region amino acid | 250 |
| | HC constant region nucleic acid | 251 |
| | HC constant region amino acid | 252 |
| | Light chain (LC) variable region nucleic acid | 253 |
| | LC variable region amino acid | 254 |
| | LC constant region nucleic acid | 255 |
| | LC constant region amino acid | 256 |
| PA15R3-P3A7 (chimeric) | Heavy chain (HC) variable nucleic acid | 257 |
| | HC variable region amino acid | 258 |
| | HC constant region nucleic acid | 259 |
| | HC constant region amino acid | 260 |
| | Light chain (LC) variable region nucleic acid | 261 |
| | LC variable region amino acid | 262 |
| | LC constant region nucleic acid | 263 |
| | LC constant region amino acid | 264 |
| PA15R3-P3C9 (chimeric) | Heavy chain (HC) variable nucleic acid | 265 |
| | HC variable region amino acid | 266 |
| | HC constant region nucleic acid | 267 |
| | HC constant region amino acid | 268 |
| | Light chain (LC) variable region nucleic acid | 269 |
| | LC variable region amino acid | 270 |
| | LC constant region nucleic acid | 271 |
| | LC constant region amino acid | 272 |
| PA16R3-P2G6 (chimeric) | Heavy chain (HC) variable nucleic acid | 273 |
| | HC variable region amino acid | 274 |
| | HC constant region nucleic acid | 275 |
| | HC constant region amino acid | 276 |
| | Light chain (LC) variable region nucleic acid | 277 |
| | LC variable region amino acid | 278 |
| | LC constant region nucleic acid | 279 |
| | LC constant region amino acid | 280 |
| PA16R3-P1A6 (chimeric) | Heavy chain (HC) variable nucleic acid | 281 |
| | HC variable region amino acid | 282 |
| | HC constant region nucleic acid | 283 |
| | HC constant region amino acid | 284 |
| | Light chain (LC) variable region nucleic acid | 285 |
| | LC variable region amino acid | 286 |
| | LC constant region nucleic acid | 287 |
| | LC constant region amino acid | 288 |
| PA16R3-P1B5 (chimeric) | Heavy chain (HC) variable nucleic acid | 289 |
| | HC variable region amino acid | 290 |
| | HC constant region nucleic acid | 291 |
| | HC constant region amino acid | 292 |
| | Light chain (LC) variable region nucleic acid | 293 |
| | LC variable region amino acid | 294 |
| | LC constant region nucleic acid | 295 |
| | LC constant region amino acid | 296 |
| PA16R3-P1E5 (chimeric) | Heavy chain (HC) variable nucleic acid | 297 |
| | HC variable region amino acid | 298 |
| | HC constant region nucleic acid | 299 |
| | HC constant region amino acid | 300 |
| | Light chain (LC) variable region nucleic acid | 301 |
| | LC variable region amino acid | 302 |
| | LC constant region nucleic acid | 303 |
| | LC constant region amino acid | 304 |
| PA16R3-P1H5 (chimeric) | Heavy chain (HC) variable nucleic acid | 305 |
| | HC variable region amino acid | 306 |
| | HC constant region nucleic acid | 307 |
| | HC constant region amino acid | 308 |
| | Light chain (LC) variable region nucleic acid | 309 |
| | LC variable region amino acid | 310 |
| | LC constant region nucleic acid | 311 |
| | LC constant region amino acid | 312 |
| PA18R3-P1D8 (chimeric) | Heavy chain (HC) variable nucleic acid | 313 |
| | HC variable region amino acid | 314 |
| | HC constant region nucleic acid | 315 |
| | HC constant region amino acid | 316 |
| | Light chain (LC) variable region nucleic acid | 317 |
| | LC variable region amino acid | 318 |
| | LC constant region nucleic acid | 319 |
| | LC constant region amino acid | 320 |
| PA18R3-P1E5 (chimeric) | Heavy chain (HC) variable nucleic acid | 321 |
| | HC variable region amino acid | 322 |
| | HC constant region nucleic acid | 323 |
| | HC constant region amino acid | 324 |
| | Light chain (LC) variable region nucleic acid | 325 |
| | LC variable region amino acid | 326 |
| | LC constant region nucleic acid | 327 |
| | LC constant region amino acid | 328 |
| PA18R3-P1H5 (chimeric) | Heavy chain (HC) variable nucleic acid | 329 |
| | HC variable region amino acid | 330 |
| | HC constant region nucleic acid | 331 |
| | HC constant region amino acid | 332 |
| | Light chain (LC) variable region nucleic acid | 333 |
| | LC variable region amino acid | 334 |
| | LC constant region nucleic acid | 335 |
| | LC constant region amino acid | 336 |

TABLE 3

Sequences of exemplary humanized antibodies

| Name/ sequence description | SEQ ID NO | Sequence |
|---|---|---|
| Humanized P1C4 light chain variable region | 337 | EIVLTQSPATLSLSPGERATLSCRASQSVSSSYLHWYQQKPGQAPRLLIYS TSNLASGIPARFSGSGSGTDFTLTISRLEPEDFAVYYCHQYHRSPPTFGQGT KVEIK |
| Humanized P1C4 full light chain | 338 | EIVLTQSPATLSLSPGERATLSCRASQSVSSSYLHWYQQKPGQAPRLLIYS TSNLASGIPARFSGSGSGTDFTLTISRLEPEDFAVYYCHQYHRSPPTFGQGT KVEIKRTVAAPSVFIFPPSDEQLKSGTASVVCLLNNFYPREAKVQWKVDN ALQSGNSQESVTEQDSKDSTYSLSSTLTLSKADYEKHKVYACEVTHQGLS SPVTKSFNRGEC |
| Humanized P1C4-H0 heavy chain variable region | 339 | QVQLVQSGAEVKKPGSSVKVSCKASGGTFSYYWMNWVRQAPGQGLEW MGQIYPGDGETKYAQKFQGRVTITADKSTSTAYMELSSLRSEDTAVYYC ARSHGNYLPYWGQGTLVTVSS |
| Humanized P1C4-H2 heavy chain variable region | 340 | QVQLVQSGAEVKKPGSSVKVSCKASGYEFSYYWMNWVRQAPGQGLEW MGQIYPGDGETKYAQKFQGRVTITADKSTSTAYMELSSLRSEDTAVYYC ARSHGNYLPYWGQGTLVTVSS |
| Humanized P1C4-H4 heavy chain variable region | 341 | QVQLVQSGAEVKKPGSSVKVSCKASGYEFSYYWMNWVRQAPGQGLEW MGQIYPGDGETKYNGKFQGRVTITADKSTSTAYMELSSLRSEDTAVYYC ARSHGNYLPYWGQGTLVTVSS |
| Humanized P1C4 heavy chain constant region | 342 | ASTKGPSVFPLAPSSKSTSGGTAALGCLVKDYFPEPVTVSWNSGALTSGV HTFPAVLQSSGLYSLSSVVTVPSSSLGTQTYICNVNHKPSNTKVDKKVEPK SCDKTHTCPPCPAPELLGGPSVFLFPPKPKDTLMISRTPEVTCVVVDVSHE DPEVKFNWYVDGVEVHNAKTKPREEQYNSTYRVVSVLTVLHQDWLNG KEYKCKVSNKALPAPIEKTISKAKGQPREPQVYTLPPSRDELTKNQVSLTC LVKGFYPSDIAVEWESNGQPENNYKTTPPVLDSDGSFFLYSKLTVDKSRW QQGNVFSCSVMHEALHNHYTQKSLSLSPGK |
| Humanized P1C4 H0 IgG2-4 Hybrid | 343 | QVQLVQSGAEVKKPGSSVKVSCKASGGTFSYYWMNWVRQAPGQGLEW MGQIYPGDGETKYAQKFQGRVTITADKSTSTAYMELSSLRSEDTAVYYC ARSHGNYLPYWGQGTLVTVSSASTKGPSVFPLAPCSRSTSESTAALGCLV KDYFPEPVTVSWNSGALTSGVHTFPAVLQSSGLYSLSSVVTVPSSNFGTQ TYTCNVDHKPSNTKVDKTVERKCCVECPPCPAPEFLGGPSVFLFPPKPKD TLMISRTPEVTCVVVDVSQEDPEVQFNWYVDGVEVHNAKTKPREEQFNS TYRVVSVLTVLHQDWLNGKEYKCKVSNKGLPSSIEKTISKAKGQPREPQV YTLPPSQEEMTKNQVSLTCLVKGFYPSDIAVEWESNGQPENNYKTTPPVL DSDGSFFLYSRLTVDKSRWQEGNVFSCSVMHEALHNHYTQKSLSLSLGK |
| Humanized P1C4 H0 IgG2A330S/ P331S | 344 | QVQLVQSGAEVKKPGSSVKVSCKASGGTFSYYWMNWVRQAPGQGLEW MGQIYPGDGETKYAQKFQGRVTITADKSTSTAYMELSSLRSEDTAVYYC ARSHGNYLPYWGQGTLVTVSSASTKGPSVFPLAPCSRSTSESTAALGCLV KDYFPEPVTVSWNSGALTSGVHTFPAVLQSSGLYSLSSVVTVPSSNFGTQ TYTCNVDHKPSNTKVDKTVERKCCVECPPCPAPPVAGPSVFLFPPKPKDT LMISRTPEVTCVVVDVSHEDPEVQFNWYVDGVEVHNAKTKPREEQFNST FRVVSVLTVVHQDWLNGKEYKCKVSNKGLPSSIEKTISKTKGQPREPQVY TLPPSREEMTKNQVSLTCLVKGFYPSDIAVEWESNGQPENNYKTTPPMLD SDGSFFLYSKLTVDKSRWQQGNVFSCSVMHEALHNHYTQKSLSLSPGK |
| Humanized P1C4 H0 IgG4S228P | 345 | QVQLVQSGAEVKKPGSSVKVSCKASGGTFSYYWMNWVRQAPGQGLEW MGQIYPGDGETKYAQKFQGRVTITADKSTSTAYMELSSLRSEDTAVYYC ARSHGNYLPYWGQGTLVTVSSASTKGPSVFPLAPCSRSTSESTAALGCLV KDYFPEPVTVSWNSGALTSGVHTFPAVLQSSGLYSLSSVVTVPSSSLGTKT YTCNVDHKPSNTKVDKRVESKYGPPCPPCPAPEFLGGPSVFLFPPKPKDTL MISRTPEVTCVVVDVSQEDPEVQFNWYVDGVEVHNAKTKPREEQFNSTY RVVSVLTVLHQDWLNGKEYKCKVSNKGLPSSIEKTISKAKGQPREPQVYT LPPSQEEMTKNQVSLTCLVKGFYPSDIAVEWESNGQPENNYKTTPPVLDS DGSFFLYSRLTVDKSRWQEGNVFSCSVMHEALHNHYTQKSLSLSLGK |
| Humanized P1C4 H2 IgG2-4 Hybrid | 346 | QVQLVQSGAEVKKPGSSVKVSCKASGYEFSYYWMNWVRQAPGQGLEW MGQIYPGDGETKYAQKFQGRVTITADKSTSTAYMELSSLRSEDTAVYYC ARSHGNYLPYWGQGTLVTVSSASTKGPSVFPLAPCSRSTSESTAALGCLV KDYFPEPVTVSWNSGALTSGVHTFPAVLQSSGLYSLSSVVTVPSSNFGTQ TYTCNVDHKPSNTKVDKTVERKCCVECPPCPAPEFLGGPSVFLFPPKPKD TLMISRTPEVTCVVVDVSQEDPEVQFNWYVDGVEVHNAKTKPREEQFNS |

TABLE 3-continued

Sequences of exemplary humanized antibodies

| Name/<br>sequence<br>description | SEQ<br>ID<br>NO | Sequence |
|---|---|---|
| | | TYRVVSVLTVLHQDWLNGKEYKCKVSNKGLPSSIEKTISKAKGQPREPQV<br>YTLPPSQEEMTKNQVSLTCLVKGFYPSDIAVEWESNGQPENNYKTTPPVL<br>DSDGSFFLYSRLTVDKSRWQEGNVFSCSVMHEALHNHYTQKSLSLSLGK |
| Humanized<br>P1C4 H2<br>IgG2A330S/<br>P331S | 347 | QVQLVQSGAEVKKPGSSVKVSCKASGYEFSYYWMNWVRQAPGQGLEW<br>MGQIYPGDGETKYAQKFQGRVTITADKSTSTAYMELSSLRSEDTAVYYC<br>ARSHGNYLPYWGQGTLVTVSSASTKGPSVFPLAPCSRSTSESTAALGCLV<br>KDYFPEPVTVSWNSGALTSGVHTFPAVLQSSGLYSLSSVVTVPSSNFGTQ<br>TYTCNVDHKPSNTKVDKTVERKCCVECPPCPAPPVAGPSVFLFPPKPKDT<br>LMISRTPEVTCVVVDVSHEDPEVQFNWYVDGVEVHNAKTKPREEQFNST<br>FRVVSVLTVVHQDWLNGKEYKCKVSNKGLPSSIEKTISKTKGQPREPQVY<br>TLPPSREEMTKNQVSLTCLVKGFYPSDIAVEWESNGQPENNYKTTPPMLD<br>SDGSFFLYSKLTVDKSRWQQGNVFSCSVMHEALHNHYTQKSLSLSPGK |
| Humanized<br>P1C4 H2<br>IgG4S228P | 348 | QVQLVQSGAEVKKPGSSVKVSCKASGYEFSYYWMNWVRQAPGQGLEW<br>MGQIYPGDGETKYAQKFQGRVTITADKSTSTAYMELSSLRSEDTAVYYC<br>ARSHGNYLPYWGQGTLVTVSSASTKGPSVFPLAPCSRSTSESTAALGCLV<br>KDYFPEPVTVSWNSGALTSGVHTFPAVLQSSGLYSLSSVVTVPSSSLGTKT<br>YTCNVDHKPSNTKVDKRVESKYGPPCPPCPAPEFLGGPSVFLFPPKPKDTL<br>MISRTPEVTCVVVDVSQEDPEVQFNWYVDGVEVHNAKTKPREEQFNSTY<br>RVVSVLTVLHQDWLNGKEYKCKVSNKGLPSSIEKTISKAKGQPREPQVYT<br>LPPSQEEMTKNQVSLTCLVKGFYPSDIAVEWESNGQPENNYKTTPPVLDS<br>DGSFFLYSRLTVDKSRWQEGNVFSCSVMHEALHNHYTQKSLSLSLGK |
| Humanized<br>P1C4 H4<br>IgG2-4<br>Hybrid | 349 | QVQLVQSGAEVKKPGSSVKVSCKASGYEFSYYWMNWVRQAPGQGLEW<br>MGQIYPGDGETKYNGKFQGRVTITADKSTSTAYMELSSLRSEDTAVYYC<br>ARSHGNYLPYWGQGTLVTVSSASTKGPSVFPLAPCSRSTSESTAALGCLV<br>KDYFPEPVTVSWNSGALTSGVHTFPAVLQSSGLYSLSSVVTVPSSNFGTQ<br>TYTCNVDHKPSNTKVDKTVERKCCVECPPCPAPEFLGGPSVFLFPPKPKD<br>TLMISRTPEVTCVVVDVSQEDPEVQFNWYVDGVEVHNAKTKPREEQFNS<br>TYRVVSVLTVLHQDWLNGKEYKCKVSNKGLPSSIEKTISKAKGQPREPQV<br>YTLPPSQEEMTKNQVSLTCLVKGFYPSDIAVEWESNGQPENNYKTTPPVL<br>DSDGSFFLYSRLTVDKSRWQEGNVFSCSVMHEALHNHYTQKSLSLSLGK |
| Humanized<br>P1C4 H4<br>IgG2A330S/<br>P331S | 350 | QVQLVQSGAEVKKPGSSVKVSCKASGYEFSYYWMNWVRQAPGQGLEW<br>MGQIYPGDGETKYNGKFQGRVTITADKSTSTAYMELSSLRSEDTAVYYC<br>ARSHGNYLPYWGQGTLVTVSSASTKGPSVFPLAPCSRSTSESTAALGCLV<br>KDYFPEPVTVSWNSGALTSGVHTFPAVLQSSGLYSLSSVVTVPSSNFGTQ<br>TYTCNVDHKPSNTKVDKTVERKCCVECPPCPAPPVAGPSVFLFPPKPKDT<br>LMISRTPEVTCVVVDVSHEDPEVQFNWYVDGVEVHNAKTKPREEQFNST<br>FRVVSVLTVVHQDWLNGKEYKCKVSNKGLPSSIEKTISKTKGQPREPQVY<br>TLPPSREEMTKNQVSLTCLVKGFYPSDIAVEWESNGQPENNYKTTPPMLD<br>SDGSFFLYSKLTVDKSRWQQGNVFSCSVMHEALHNHYTQKSLSLSPGK |
| Humanized<br>P1C4 H4<br>IgG4S228P | 351 | QVQLVQSGAEVKKPGSSVKVSCKASGYEFSYYWMNWVRQAPGQGLEW<br>MGQIYPGDGETKYNGKFQGRVTITADKSTSTAYMELSSLRSEDTAVYYC<br>ARSHGNYLPYWGQGTLVTVSSASTKGPSVFPLAPCSRSTSESTAALGCLV<br>KDYFPEPVTVSWNSGALTSGVHTFPAVLQSSGLYSLSSVVTVPSSSLGTKT<br>YTCNVDHKPSNTKVDKRVESKYGPPCPPCPAPEFLGGPSVFLFPPKPKDTL<br>MISRTPEVTCVVVDVSQEDPEVQFNWYVDGVEVHNAKTKPREEQFNSTY<br>RVVSVLTVLHQDWLNGKEYKCKVSNKGLPSSIEKTISKAKGQPREPQVYT<br>LPPSQEEMTKNQVSLTCLVKGFYPSDIAVEWESNGQPENNYKTTPPVLDS<br>DGSFFLYSRLTVDKSRWQEGNVFSCSVMHEALHNHYTQKSLSLSLGK |

In some embodiments, the anti-CB1 receptor antibodies provided herein comprise the sequences provided herein or conservative variants thereof "Conservative variants," as used herein, include conservative amino acid substitutions, insertions, or deletions. The person of skill in the art will recognize that a conservative amino acid substitution is a substitution of one amino acid with another amino acid that has a similar structural or chemical properties, such as, for example, a similar side chain; and a conservative amino acid substitution, insertion or deletion results in a sequence that retains the biological activity of the reference sequence. Exemplary conservative substitutions are described in the art, for example, in Watson et al., *Molecular Biology of the Gene*, The Bengamin/Cummings Publication Company, 4th Ed. (1987).

III. Methods of Treating CB1-Associated Disorders

The antibodies and antigen binding fragments thereof disclosed herein can be administered to a human subject for therapeutic purposes. In some embodiments, methods of treatment comprising administering the antibodies and binding fragments or variants thereof disclosed herein to a subject.

In certain embodiments, methods are provided for treatment of diseases wherein the peripheral CB1 receptors are preferentially targeted. "Peripheral CB1 receptors", as defined herein, are those CB1 receptors that are not localized to the brain or central nervous system (e.g. peripherally restricted CB1 receptors). In contrast, the term "global CB1 receptors" refers to CB1 receptors anywhere in the body, including the brain and CNS.

In one embodiment, the isolated antibodies and antigen binding fragments thereof are useful in the treatment of various diseases or disorders such as, for example, obesity, diabetes, dyslipidemia, fibrosis, non-alcoholic steatohepatitis (NASH), liver diseases, primary biliary cirrhosis, cardiovascular disease, cancer, pain, multiple sclerosis (MS) spasticity, glaucoma, inflammatory diseases, nephropathies, osteoporosis, metabolic disorders, psychiatric disorders, neurological disorders, neurodegenerative disorders, reproductive disorders, renal disease, kidney fibrosis, chronic kidney disease, atherosclerosis, cancer, and skin disorders, among others.

CB1 receptor signaling has been shown to exhibit detrimental activity in, for example, obesity, diabetes, fibrosis, liver diseases, cardiovascular disease, and cancer. (Kunos et al., 2009, Trends Pharmacol Sci 30:1-7.) In one aspect, the anti-CB1 antibodies, or fragments thereof, disclosed herein are useful for antagonizing CB1 activity. Accordingly, in another aspect, the invention provides methods for treating CB1-associated diseases or disorders by administering to a subject in need of thereof a pharmaceutical composition comprising one or more anti-CB1 antibodies, or antigen binding fragments thereof disclosed herein. In some embodiments, the antagonistic CB1 receptor antibodies and fragments thereof provided herein provide a beneficial effect when used as a treatment for, or for prevention of, obesity, diabetes, fibrosis, liver diseases, cardiovascular diseases, addictions such as nicotine addiction, or cancers.

Nonalcoholic steatohepatitis (NASH), also known as nonalcoholic fatty liver disease (NAFLD), refers to the accumulation of hepatic steatosis not due to excess alcohol consumption. NASH is a liver disease characterized by inflammation of the liver with concurrent fat accumulation. NASH is also frequently found in people with diabetes and obesity and is related to metabolic syndrome. NASH is the progressive form of the relatively benign non-alcoholic fatty liver disease, for it can slowly worsen causing fibrosis accumulation in the liver, which leads to cirrhosis (reviewed in Smith, et al., 2011, Crit Rev Clin Lab Sci., 48(3):97-113). Currently, no specific therapies for NASH exist.

In one aspect, the anti-CB1 antibodies or fragments thereof disclosed herein are used in the treatment, prevention, detection, or study of fibrosis. Several studies in mouse models have confirmed the role of CB1 receptor in fibrosis, including liver fibrosis. (See, e.g., Wei et al., 2014, Exp. Biol. Med. 239(2):183-192; Tam et al., 2010, J. Clin. Invest. 120(8):2953-66; Wan et al., 2014, Cell Metabolism, 19(6): 900-1; Takano et al., 2014, Synapse, 68:89-97). Peripheral CB1 has been implicated in several mechanisms contributing to NASH and liver fibrosis, including steatosis (fatty liver), inflammation, and liver injury (reviewed by Mallat et al., 2013, J Hepatology, 59(4):891-896). CB1 has been demonstrated to be up-regulated in activated human hepatic stellate cells (HSC), which mediate fibrosis by transitioning into myofibroblasts. (Teixeira-Clerc et al., 2006, Nature Med., 12(6):671-76). CB1 has also been implicated in diabetic nephropathy. Lin et al., 2014 J. Mol. Med. 92(7): 779-92.)

Studies in hepatocyte-specific and global CB1-knockout mice have implicated a major role of CB1 in peripheral cell type (hepatocytes) relevant to several metabolic diseases and disorders. In a mouse model of diet-induced obesity, both global CB1 knockout (CB1-/-) and hepatocyte-specific CB1 knockout (LCB1-/-) demonstrated reduced steatosis (fatty liver) and increased liver function, thus demonstrating a role of CB1 in peripheral cell type (hepatocytes) relevant to non-alcoholic steatohepatitis (NASH), diabetes, and metabolic syndrome disease pathologies. (Osei-Hyiaman et al., 2008, J. Clin. Invest., 118(9):3160-3169; Liu et al., 2012, Gastroenterology, 142:1218-1228). Selective knockdown of CB1 using a macrophage-specific CB1 knockdown siRNA (CB1R-GeRPs) prevents progressive hyperglycemia and decline in plasma insulin and C-peptide in Zucker diabetic fatty (ZDF) rats, which are a common model for T2D insulin resistance, hyperglycemia and beta cell failure. (Jourdan et al., 2013, Nature Med. 19(9):1132-1140) In a mouse model of alcohol-induced liver steatosis, both global CB1 knockout (CB1-/-) and hepatocyte-specific CB1 knockout (LCB1-/-) have reduced steatosis and increased liver function, thus demonstrating a role of CB1 in peripheral cell type (hepatocytes) relevant to steatosis disease pathology. (Jeong, et al., 2008, Cell Metabolism, 7:227-235). Lipid accumulation was shown to be reduced in epididymal white adipose cell lines generated from CB1 knockout mice relative to wild-type control (Wagner et al., 2011, Nutrition and Diabetes, 1:e16).

Studies in different models of disease in mouse have shown that peripherally-restricted CB1 receptor small molecule antagonists can effectively inhibit liver fibrosis progression. (See, e.g., Wei et al., 2014, Exp. Biol. Med. 239(2):183-192; Tam et al., 2010, J. Clin. Invest. 120(8): 2953-66; Wan et al., 2014, Cell Metabolism, 19(6):900-1; Takano et al., 2014, Synapse, 68:89-97.) Non-limiting examples of known CB1 antagonists include rimonabant, taranabant, VD60, Isis-414930 Antisense CB1, JD5037, AM6545, and TM38837. CB1 antagonists such as rimonabant have been shown to inhibit cell proliferation and down-regulate pro-fibrotic gene expression in primary human hepatic stellate cells (HSC), which mediate fibrosis by transitioning into myofibroblasts (Patsenker et al., 2011, Mol Med., 17(11-12):1285-1294). In the $CCl_4$-induced liver fibrosis mouse model, CB1 antagonist VD60 (3,4,22-3-dimethoxycarbonyl-3-hydroxylmethyl-4-deacetyl-vindoline 3,4-thionocarbonate) was demonstrated to inhibit production of pro-fibrotic gene expression (alpha collagen) and proliferation in activated hepatic stellate cells (HSC line LX-2), while selective CB1 agonist ACEA (N-(2-chloroethyl)-5Z,8Z,11Z,14Z-eicosatetraenamide) prevented this effect (Wei Y. et al., 2014, Exp. Biol. Med. 239(2):183-192). CB1 antagonist JD5037 has been shown to reverse endocannabinoid-induced inhibition of insulin signaling. (Cinar et al., 2014, Hepatology, 59(1)143-153). CB1 blockade using rimonabant reverses inflammation-induced impairment of glucose uptake in adipocytes isolated from high-fat diet rats (Miranville et al, 2010, Obesity 18: 2247-2254).

Human studies also link peripheral CB1 receptors to disease etiology and progression. For example, up-regulation of CB1 in liver of NASH and HCV patients correlated with severity of liver steatosis and fibrosis. (Auguet et al., 2014, BioMed Res. Intl. Vol. 2014, Article ID 502542). In addition, chronic CB1 agonism (via cannabis use) correlated with increased severity of liver steatosis and fibrosis in HCV patients. (Van der Poorten et al., 2010, PlosOne 5, e12841) Furthermore, it has been shown that CB1 blockade in obese patients improves liver steatosis. (Despres et al., 2009, Arterioscler Thromb Vasc Biol. 29:416-423).

It will also be recognized that the effect of CB1 antagonism differs depending on the location of the receptor. For instance, it is known that the effects of CB1 antagonism are tissue specific, as beneficial cardiometabolic effects of rimonabant observed in patients are independent of weight loss. (Pi-Sunyer et al, 2006, J Am Coll Cardio. 147: 362A). Furthermore, it is known that rimonabant improves glycemic control in type 2 diabetes patients, (see, e.g., Hollander et al., 2010, Diabetes Care. 33(3):605-7) but that this effect is accompanied by significant psychiatric side effects imparted by CB1 receptors located in the CNS. (Kunos et al, 2009, Trends Pharmacol Sci 30:1-7; Moreira et al., 2009, Rev Bras Psiquiatr. 31(2):145-53; Pacher et al, 2013, FEBS J. 280(9): 1918-1943.) The CB1 receptor antagonist rimonabant was shown to improve the profile of several metabolic risk factors (including adiponectin levels) in overweight patients according to the Rimonabant in Obesity-Lipids (RIO-Lipids) study. (See, e.g., Després et al., 2005, N Engl J Med, 353:2121-2134).

CB1 receptor signaling has been shown to exhibit beneficial activity in and pain, MS spasticity, and glaucoma, among others. (Pacher et al., 2013, FEBS J. 280(9):1918-1943). In some embodiments, the agonistic CB1 receptor antibodies and fragments thereof provided herein provide a beneficial effect when used as a treatment for, or for prevention of, pain, MS spasticity, or glaucoma. CB1 agonists have been demonstrated to activate liver fatty acid synthesis, gluconeogenesis, and other metabolic pathways. (See, e.g., Osei-Hyiaman et al, 2005, J. Clin. Invest., 115(5):1298-1305; Chanda et al., 2012, JBC, 287(45):38041-38049).

Multiple Sclerosis (MS) spasticity refers to feelings of stiffness and a wide range of involuntary muscle spasms (sustained muscle contractions or sudden movements). Spasticity is one of the more common symptoms of MS, and can vary in degree from mild tightness to painful, uncontrollable spasms of extremities. Left untreated, spasticity can lead to serious complications, including contractures (frozen or immobilized joints) and pressure sores. Current treatment options for MS spasticity include baclofen, tizanidine, diazepam, dantrolene, phenol, among others. CB1 receptors have been shown to mediate control of spasticity in a mouse model of MS. (Pryce et al., 2007, Br J Pharmacol. 150(4): 519-525).

Activation of CB1 receptors produces analgesic effects in several experimental pain models, including visceral pain arising from the gastrointestinal tract. CB1 agonists such as WIN55,212-2 and SAB-378 have also been shown to inhibit pain-related responses to repetitive noxious stimuli (Brusberg et al., 2009, J. Neuroscience, 29(5):1554-1564; Talwar et al., 2011, CNS Neurol Disord Drug Targets. 10(5):536-44.)

One skilled in the art would be able, by routine experimentation, to determine what an effective, non-toxic amount of antibody (or additional therapeutic agent) would be for the purpose of treating a CB1-associated disease or disorder. For example, a therapeutically active amount of a polypeptide may vary according to factors such as the disease stage (e.g., stage I versus stage IV), age, sex, medical complications (e.g., immunosuppressed conditions or diseases) and weight of the subject, and the ability of the antibody to elicit a desired response in the subject. The dosage regimen may be adjusted to provide the optimum therapeutic response. For example, several divided doses may be administered daily, or the dose may be proportionally reduced as indicated by the exigencies of the therapeutic situation. Generally, however, an effective dosage is expected to be in the range of about 0.05 to 100 milligrams per kilogram body weight per day and in an embodiment from about 0.5 to 10, milligrams per kilogram body weight per day.

In some embodiments, the anti-CB1 antibodies and fragments disclosed herein are used in methods utilizing a combination therapy wherein human antibodies are administered to a subject with another therapeutic agent, such as one or more additional antibodies that bind other targets (e.g., antibodies that bind other cytokines or that bind cell surface molecules). Because signaling pathway redundancies can result in lack of response to a single antibody, diverse strategies to use combination therapy with antibodies that bind to different epitopes or different antigens on the same target cell have been proposed. Combinations such as anti-CD20 and anti-CD22 (Stein et al., Clin Cancer Res 2004, 10:2868-2878), anti-CD20 and anti-HLA-DR (Tobin et al., Leuk Lymphoma 2007, 48:944-956), anti-CD20 and anti-TRAIL-R1 (Maddipatla et al., Clin Cancer Res 2007, 13:4556-4564), anti-IGF-1R and anti-EGFR (Goetsche et al., Int J Cancer 2005, 113:316-328), anti-IGF-1R and anti-VEGF (Shang et al., Mol Cancer Ther 2008, 7:2599-2608), or trastuzumab and pertuzumab that target different regions of human EGFR2 (Nahta et al., Cancer Res 2004, 64:2343-2346) have been evaluated preclinically, showing enhanced or synergistic antitumor activity in vitro and in vivo. Such combination therapies may advantageously utilize lower dosages of the administered therapeutic agents, thus avoiding possible toxicities or complications associated with the various monotherapies.

The antibodies and fragments disclosed herein can be administered in combination with any desired therapeutic agent. In certain embodiments, the antibodies and fragments disclosed herein are administered in combination with, for example, a LOXL2 antibody, TGFβ antibody, nintedanib, tyrosine kinase inhibitor, PPAR agonist, Farnesoid X receptor (FXR) agonist, glucagon-like peptide 1 receptor agonist, or caspase inhibitor.

IV. Pharmaceutical Compositions

In another aspect, the invention provides pharmaceutical compositions comprising an anti-CB1 antibody, or fragment thereof.

Methods of preparing and administering antibodies, or fragments thereof, disclosed herein to a subject are well known to or are readily determined by those skilled in the art. The route of administration of the antibodies, or fragments thereof, disclosed herein may be oral, parenteral, by inhalation or topical. The term parenteral as used herein includes intravenous, intraarterial, intraperitoneal, intramuscular, subcutaneous, rectal or vaginal administration. The intravenous, intraarterial, subcutaneous and intramuscular forms of parenteral administration can be used in certain embodiments. While all these forms of administration are clearly contemplated as being within the scope disclosed herein, a form for administration would be a solution for injection, in particular for intravenous or intraarterial injection or drip. Usually, a suitable pharmaceutical composition for injection may comprise a buffer (e.g. acetate, phosphate or citrate buffer), a surfactant (e.g. polysorbate), optionally a stabilizer agent (e.g. human albumin), etc. However, in other methods compatible with the teachings herein, the polypeptides can be delivered directly to the site of the adverse cellular population thereby increasing the exposure of the diseased tissue to the therapeutic agent.

Preparations for parenteral administration include sterile aqueous or non-aqueous solutions, suspensions, and emulsions. Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. In the subject invention, pharmaceutically acceptable carriers include, but are not limited to, 0.01-0.1 M (e.g. 0.05 M) phosphate buffer or 0.8% saline. Other common parenteral vehicles include sodium phosphate solutions, Ringer's dextrose, dextrose and sodium chloride, lactated Ringer's, or fixed oils. Intravenous vehicles include fluid and nutrient replenishers, electrolyte replenishers, such as those based on Ringer's dextrose, and the like. Preservatives and other additives may also be present such as for example, antimicrobials, antioxidants, chelating agents, and inert gases and the like. More particularly, pharmaceutical compositions suitable for injectable use include sterile aqueous solutions (where water soluble) or dispersions and sterile powders for the extemporaneous preparation of sterile injectable solutions or dispersions. In such cases, the composition must be sterile and should be fluid to the extent that easy syringability exists. It should be stable under the conditions of manufacture and storage and will in an embodiment be preserved against the contaminating action of microorganisms, such as bacteria and fungi. The carrier can be a solvent or dispersion medium containing, for example, water, ethanol, polyol (e.g., glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal and the like. In certain embodiments, isotonic agents are included, for example, sugars, polyalcohols, such as mannitol, sorbitol, or sodium chloride in the composition. Prolonged absorption of the injectable compositions can be brought about by including in the composition an agent which delays absorption, for example, aluminum monostearate and gelatin.

In any case, sterile injectable solutions can be prepared by incorporating an active compound (e.g., an antibody by itself or in combination with other active agents) in the required amount in an appropriate solvent with one or a combination of ingredients enumerated herein, as required, followed by filtered sterilization. Generally, dispersions are prepared by incorporating the active compound into a sterile vehicle, which contains a basic dispersion medium and the required other ingredients from those enumerated above. In the case of sterile powders for the preparation of sterile injectable solutions, the methods of preparation can be vacuum drying and freeze-drying, which yields a powder of an active ingredient plus any additional desired ingredient from a previously sterile-filtered solution thereof. The preparations for injections are processed, filled into containers such as ampoules, bags, bottles, syringes or vials, and sealed under aseptic conditions according to methods known in the art. Further, the preparations may be packaged and sold in the form of a kit such as those described in co-pending U.S. Ser. No. 09/259,337 and U.S. Ser. No. 09/259,338 each of which is incorporated herein by reference. Such articles of manufacture will in an embodiment have labels or package inserts indicating that the associated compositions are useful for treating a subject suffering from, or predisposed to autoimmune or neoplastic disorders.

Effective doses of the stabilized antibodies, or fragments thereof, disclosed herein, for the treatment of the above described conditions vary depending upon many different factors, including means of administration, target site, physiological state of the patient, whether the patient is human or an animal, other medications administered, and whether treatment is prophylactic or therapeutic. Usually, the patient is a human, but non-human mammals including transgenic mammals can also be treated. Treatment dosages may be titrated using routine methods known to those of skill in the art to optimize safety and efficacy.

For passive immunization with an antibody disclosed herein, the dosage may range, e.g., from about 0.0001 to 100 mg/kg, and more usually 0.01 to 5 mg/kg (e.g., 0.02 mg/kg, 0.25 mg/kg, 0.5 mg/kg, 0.75 mg/kg, 1 mg/kg, 2 mg/kg, etc.), of the host body weight. For example dosages can be 1 mg/kg body weight or 10 mg/kg body weight or within the range of 1-10 mg/kg, or in particular embodiments at least 1 mg/kg. Doses intermediate in the above ranges are also intended to be within the scope disclosed herein.

Subjects can be administered such doses daily, on alternative days, weekly or according to any other schedule determined by empirical analysis. An exemplary treatment entails administration in multiple dosages over a prolonged period, for example, of at least six months. Additional exemplary treatment regimens entail administration once per every two weeks or once a month or once every 3 to 6 months. Exemplary dosage schedules include 1-10 mg/kg or 15 mg/kg on consecutive days, 30 mg/kg on alternate days or 60 mg/kg weekly. In some methods, two or more monoclonal antibodies with different binding specificities are administered simultaneously, in which case the dosage of each antibody administered may fall within the ranges indicated.

Antibodies or fragments thereof, disclosed herein can be administered on multiple occasions. Intervals between single dosages can be, e.g., daily, weekly, monthly or yearly. Intervals can also be irregular as indicated by measuring blood levels of polypeptide or target molecule in the patient. In some methods, dosage is adjusted to achieve a certain plasma antibody or toxin concentration, e.g., 1-1000 ug/ml or 25-300 ug/ml. Alternatively, antibodies, or fragments thereof, can be administered as a sustained release formulation, in which case less frequent administration is required. Dosage and frequency vary depending on the half-life of the antibody in the patient. In general, humanized antibodies show the longest half-life, followed by chimeric antibodies and nonhuman antibodies. In one embodiment, the antibodies, or fragments thereof, disclosed herein can be administered in unconjugated form. In another embodiment, the antibodies disclosed herein can be administered multiple times in conjugated form. In still another embodiment, the antibodies, or fragments thereof, disclosed herein can be administered in unconjugated form, then in conjugated form, or vice versa.

The dosage and frequency of administration can vary depending on whether the treatment is prophylactic or therapeutic. In prophylactic applications, compositions containing the present antibodies or a cocktail thereof are administered to a patient not already in the disease state to enhance the patient's resistance. Such an amount is defined to be a "prophylactic effective dose." In this use, the precise amounts again depend upon the patient's state of health and general immunity, but generally range from 0.1 to 25 mg per dose, especially 0.5 to 2.5 mg per dose. A relatively low dosage is administered at relatively infrequent intervals over a long period of time. Some patients continue to receive treatment for the rest of their lives.

In therapeutic applications, a relatively high dosage (e.g., from about 1 to 400 mg/kg of antibody per dose, with dosages of from 5 to 25 mg being more commonly used for radioimmunoconjugates and higher doses for cytotoxin-drug conjugated molecules) at relatively short intervals is sometimes required until progression of the disease is reduced or terminated, and, in particular embodiments, until the patient shows partial or complete amelioration of symptoms of disease. Thereafter, the patient can be administered a prophylactic regime.

In one embodiment, a subject can be treated with a nucleic acid molecule encoding a polypeptide disclosed herein (e.g., in a vector). Doses for nucleic acids encoding polypeptides range from about 10 ng to 1 g, 100 ng to 100 mg, 1 ug to 10 mg, or 30-300 ug DNA per patient. Doses for infectious viral vectors vary from 10-100, or more, virions per dose.

Therapeutic agents can be administered by parenteral, topical, intravenous, oral, subcutaneous, intraarterial, intracranial, intraperitoneal, intranasal or intramuscular means for prophylactic or therapeutic treatment. Intramuscular injection or intravenous infusion can be used for administration of an antibody disclosed herein. In some methods, therapeutic antibodies, or fragments thereof, are injected directly into the cranium. In some methods, antibodies, or fragments thereof, are administered as a sustained release composition or device, such as a Medipad™ device.

Agents disclosed herein can optionally be administered in combination with other agents that are effective in treating the disorder or condition in need of treatment (e.g., prophylactic or therapeutic). Additional agents are those which are art recognized and are routinely administered for a particular disorder.

While a great deal of clinical experience has been gained with 131I and 90Y, other radiolabels are known in the art and have been used for similar purposes. Still other radioisotopes are used for imaging. For example, additional radioisotopes which are compatible with the scope of the instant invention include, but are not limited to, 123I, 125I, 32P, 57Co, 64Cu, 67Cu, 77Br, 81Rb, 81Kr, 87Sr, 113In, 127Cs, 129Cs, 132I, 197Hg, 203Pb, 206Bi, 177Lu, 186Re, 212Pb, 212Bi, 47Sc, 105Rh, 109Pd, 153Sm, 188Re, 199Au, 225Ac, 211A 213Bi. In this respect alpha, gamma and beta emitters are all compatible with in the instant invention. Further, in view of the instant disclosure it is submitted that one skilled in the art could readily determine which radionuclides are compatible with a selected course of treatment without undue experimentation. To this end, additional radionuclides which have already been used in clinical diagnosis include 125I, 123I, 99Tc, 43K, 52Fe, 67Ga, 68Ga, as well as 111In. Antibodies have also been labeled with a variety of radionuclides for potential use in targeted immunotherapy (Peirersz et al. Immunol. Cell Biol. 65: 111, 1987). These radionuclides include 188Re and 186Re as well as 199Au and 67Cu to a lesser extent. U.S. Pat. No. 5,460,785 provides additional data regarding such radioisotopes and is incorporated herein by reference.

As previously discussed, the antibodies, or fragments thereof, disclosed herein can be administered in a pharmaceutically effective amount for the in vivo treatment of mammalian disorders. In this regard, it will be appreciated that the disclosed antibodies, or fragments thereof, will be formulated so as to facilitate administration and promote stability of the active agent. In certain embodiments, pharmaceutical compositions in accordance with the present invention comprise a pharmaceutically acceptable, non-toxic, sterile carrier such as physiological saline, non-toxic buffers, preservatives and the like. For the purposes of the instant application, a pharmaceutically effective amount of an antibody disclosed herein, conjugated or unconjugated to a therapeutic agent, shall be held to mean an amount sufficient to achieve effective binding to a target and to achieve a benefit, e.g., to ameliorate symptoms of a disease or disorder or to detect a substance or a cell. In the case of tumor cells, the polypeptide will in certain embodiments be capable of interacting with selected immunoreactive antigens on neoplastic or immunoreactive cells and provide for an increase in the death of those cells. Of course, the pharmaceutical compositions disclosed herein may be administered in single or multiple doses to provide for a pharmaceutically effective amount of the polypeptide.

In keeping with the scope of the present disclosure, the antibodies disclosed herein may be administered to a human or other animal in accordance with the aforementioned methods of treatment in an amount sufficient to produce a therapeutic or prophylactic effect. The polypeptides disclosed herein can be administered to such human or other animal in a conventional dosage form prepared by combining the antibody disclosed herein with a conventional pharmaceutically acceptable carrier or diluent according to known techniques. It will be recognized by one of skill in the art that the form and character of the pharmaceutically acceptable carrier or diluent is dictated by the amount of active ingredient with which it is to be combined, the route of administration and other well-known variables. Those skilled in the art will further appreciate that a cocktail comprising one or more species of polypeptides according to the present invention may prove to be particularly effective.

Also disclosed herein is a method of treating a condition caused by increased expression of CB1 or increased sensitivity to CB1 comprising administering to a patient or other subject orally, parenterally by a solution for injection, by inhalation, or topically a pharmaceutically effective amount of a CB1 antibody.

Also disclosed herein is the use of a pharmaceutically effective amount of a CB1 antibody for the manufacture of a medicament for treating a condition caused by increased expression of CB1 or increased sensitivity to CB1 comprising administering to a patient or other subject orally, parenterally by a solution for injection, by inhalation, or topically.

In some embodiments, the disclosed isolated antibodies and antigen binding fragments thereof have the advantage of minimal brain penetration. In some embodiments, the isolated antibodies and fragments thereof exhibit high selectivity for CB1 receptor and do not penetrate the blood brain barrier, or exhibit reduced penetration of the blood brain barrier relative to small molecule CB1 receptor compounds, so that CNS side effects are minimized. In further embodiments, the isolated antibodies and fragments thereof do not penetrate the blood brain barrier, or exhibit reduced penetration of the blood brain barrier relative to small molecule CB1 receptor compounds such as rimonabant, following intravenous injection.

In one embodiment, the antibodies and binding fragments or variants thereof disclosed herein may be administered to the subject by at least one route selected from parenteral, subcutaneous, intramuscular, intravenous, intrarticular, intrabronchial, intraabdominal, intracapsular, intracartilaginous, intracavitary, intracelial, intracerebellar, intracerebroventricular, intracolic, intracervical, intragastric, intrahepatic, intramyocardial, intraosteal, intrapelvic, intrapericardiac, intraperitoneal, intrapleural, intraprostatic, intrapulmonary, intrarectal, intrarenal, intraretinal, intraspinal, intrasynovial, intrathoracic, intratympanic, intrauterine, intravesical, intravitreal, bolus, subconjunctival, vaginal, rectal, buccal, sublingual, intranasal, and transdermal.

The present invention provides isolated antibodies and antigen binding fragments thereof, and nucleic acids encoding such antibodies and fragments, as well as compositions comprising such isolated antibodies, fragments, and nucleic acids. The present invention further provides pharmaceutical compositions comprising the isolated antibodies or fragments thereof, or nucleic acids encoding such antibodies or fragments, and further comprising one or more pharmaceutically acceptable carrier. Pharmaceutically acceptable carriers include, for example, excipients, diluents, encapsulating materials, fillers, buffers, or other agents.

Description of Particular Aspects and Embodiments

The different aspects disclosed herein and their embodiments can be combined with each other. In addition, any of the aspects and their embodiments described above can be combined with any of the particular aspects and embodiments described herein below.

Some particular aspects and embodiments that further serve to illustrate the present invention are provided in the following:

1. An isolated antibody or antigen binding fragment thereof that binds to cannabinoid 1 (CB1) receptor, wherein the antibody or fragment has a binding affinity Kd for CB1 receptor of about 1 µM or less.

2. The isolated antibody or antigen binding fragment of embodiment 1, wherein the antibody or fragment has a binding affinity Kd for CB1 receptor of about 100 nM or less.

3. The isolated antibody or antigen binding fragment of embodiment 1, wherein the antibody or fragment has a binding affinity Kd for CB1 receptor of about 10 nM or less.

4. The isolated antibody or antigen binding fragment of embodiment 1, wherein the antibody or fragment has a binding affinity Kd for CB1 receptor of about 1 nM or less.

5. The isolated antibody or antigen binding fragment of embodiment 1, wherein the antibody or fragment binds to an extracellular epitope on CB1 receptor.

6. The isolated antibody or antigen binding fragment of embodiment 1, wherein the antibody or fragment binds to human CB1 receptor.

7. The isolated antibody or antigen binding fragment of embodiment 1, wherein the antibody or fragment inhibits CB1 receptor signaling activity.

8. The isolated antibody or antigen binding fragment of embodiment 7, wherein the antibody or fragment has CB1 receptor signaling inhibiting activity that is at least equivalent in potency relative to small molecule rimonabant, wherein the potency is measured by inhibition of CB1 receptor agonist-mediated signal transduction in a cAMP assay.

9. The isolated antibody or antigen binding fragment of embodiment 7, wherein the antibody or fragment has CB1 receptor signaling inhibiting activity that is at least 3 fold more potent relative to small molecule rimonabant, wherein the potency is measured by inhibition of CB1 receptor agonist-mediated signal transduction in a cAMP assay.

10. The isolated antibody or antigen binding fragment of embodiment 7, wherein the antibody or fragment has CB1 receptor signaling inhibiting activity that is at least equivalent in potency relative to small molecule rimonabant, wherein the potency is measured by the inhibition of CB1 receptor agonist-mediated ERK phosphorylation.

11. The isolated antibody or antigen binding fragment of embodiment 7, wherein the antibody or fragment has CB1 receptor signaling inhibiting activity that is at least 3 fold more potent relative to small molecule rimonabant, wherein the potency is measured by the inhibition of CB1 receptor agonist-mediated ERK phosphorylation.

12. The isolated antibody or antigen binding fragment of embodiment 1, wherein the antibody or fragment activates or enhances CB1 receptor activity.

13. The isolated antibody or antigen binding fragment of embodiment 1, wherein the antibody or fragment is an allosteric modulator of CB1 receptor.

14. The isolated antibody or antigen binding fragment of embodiment 1, wherein the antibody or fragment is an inverse agonist of CB1 receptor.

15. The isolated antibody or antigen binding fragment of embodiment 1, wherein the antibody or fragment is murine.

16. The isolated antibody or antigen binding fragment of embodiment 1, wherein the antibody or fragment is chimeric.

17. The isolated antibody or antigen binding fragment of embodiment 1, wherein the antibody or fragment is humanized.

18. The isolated antibody or antigen binding fragment of embodiment 1, wherein the antibody or fragment selectively binds CB1.

19. The isolated antibody or antigen binding fragment of embodiment 1, wherein the antibody is conjugated to an agent, for example, an additional therapeutic agent, a cytotoxic agent, an immunoadhesion molecule, or an imaging agent.

20. The isolated antibody or antigen binding fragment of embodiment 19, wherein the agent is an additional therapeutic agent, a cytotoxic agent, an immunoadhesion molecule, or an imaging agent.

21. The isolated antibody or antigen binding fragment of embodiment 20, wherein the therapeutic agent is rimonabant.

22. The isolated antibody or antigen binding fragment of embodiment 20, wherein the imaging agent is selected from the group consisting of a radiolabel, an enzyme, a fluorescent label, a luminescent label, a bioluminescent label, a magnetic label, and biotin.

23. The isolated antibody or antigen binding fragment of embodiment 18, wherein the antibody does not have agonistic or antagonistic activity.

24. An antibody or antigen binding fragment thereof that is capable of competing for binding to CB1 receptor with the antibody or antigen binding fragment according to embodiment 1.

25. An antibody or antigen binding fragment thereof that is capable of specifically binding to essentially the same epitope on CB1 receptor as the antibody or antigen binding fragment according to embodiment 1.

26. The isolated antibody or antigen binding fragment of embodiment 1, wherein the antibody or antigen binding fragment thereof comprises: a heavy chain variable region comprising an amino acid sequence selected from the group consisting of SEQ ID NOs: 2, 10, 18, and 26; and a light chain variable region comprising an amino acid sequence selected from the group consisting of SEQ ID NOs: 6, 14, 22, and 30.

27. The isolated antibody or antigen binding fragment of embodiment 1, wherein the antibody or fragment comprises a heavy chain constant region comprising an amino acid sequence selected from the group consisting of SEQ ID NOs: 4, 12, 20, and 28, and a light chain constant region selected from the group consisting of SEQ ID NOs: 8, 16, 24, and 32.

28. The isolated antibody or antigen binding fragment of embodiment 1, wherein the antibody or fragment thereof comprises a heavy chain variable region comprising an amino acid sequence according to SEQ ID NO: 2; a heavy chain constant region comprising an amino acid sequence according to SEQ ID NO: 4; a light chain variable region comprising an amino acid sequence according to SEQ ID NO: 6, and a light chain constant region comprising an amino acid sequence according to SEQ ID NO: 8.

29. The isolated antibody or antigen binding fragment of embodiment 1, wherein the antibody or fragment thereof comprises a heavy chain variable region comprising an amino acid sequence according to SEQ ID NO: 10; a heavy chain constant region comprising an amino acid sequence according to SEQ ID NO: 12; a light chain variable region comprising an amino acid sequence according to SEQ ID NO: 14, and a light chain constant region comprising an amino acid sequence according to SEQ ID NO: 16.

30. The isolated antibody or antigen binding fragment of embodiment 1, wherein the antibody or fragment thereof comprises a heavy chain variable region comprising an amino acid sequence according to SEQ ID NO: 18; a heavy chain constant region comprising an amino acid sequence according to SEQ ID NO: 20; a light chain variable region comprising an amino acid sequence according to SEQ ID NO: 22, and a light chain constant region comprising an amino acid sequence according to SEQ ID NO: 24.

31. The isolated antibody or antigen binding fragment of embodiment 1, wherein the antibody or fragment thereof comprises a heavy chain variable region comprises an amino acid sequence according to SEQ ID NO: 26; a heavy chain constant region according to SEQ ID NO: 28; a light chain variable region according to SEQ ID NO: 30, and a light chain constant region according to SEQ ID NO: 32.

32. A method of antagonizing CB1, the method comprising contacting a cell expressing CB1 receptor with an antibody or binding fragment according to embodiment 1.

33. A method of agonizing CB1, the method comprising contacting a cell expressing CB1 receptor with an antibody or binding fragment according to embodiment 1.

34. A method of treating a disease or disorder responsive to antagonism or agonism of CB1 receptor in a subject in need thereof, the method comprising administering to the subject an antibody or antigen binding fragment according to embodiment 1.

35. The method of embodiment 34, wherein the subject is a human.

36. A method for detecting CB1, comprising contacting a cell with an antibody or antigen binding fragment according to embodiment 1.

37. The method of embodiment 34, wherein the disease or disorder is selected from the group consisting of obesity, diabetes, dyslipidemia, metabolic diseases, fibrosis, non-alcoholic steatohepatitis (NASH), liver disease, primary biliary cirrhosis, renal disease, kidney fibrosis, chronic kidney disease, osteoporosis, atherosclerosis, cardiovascular disease, cancer, and inflammatory disease.

38. The method of embodiment 34, wherein the disease or disorder is selected from the group consisting of pain, multiple sclerosis spasticity and glaucoma.

39. The method of embodiment 37, wherein the disease or disorder is fibrosis.

40. The method of embodiment 37, wherein the antibody or antigen binding fragment antagonizes CB1.

41. The method of embodiment 38, wherein the antibody or antigen binding fragment agonizes CB1.

42. A method for diagnosing a disease or disorder associated with CB1, the method comprising contacting a cell with an antibody or antigen binding fragment according to embodiment 1.

43. A method for determining the prognosis for a subject diagnosed with a disease or disorder associated with CB1, the method comprising measuring CB1 expression by contacting a cell with an antibody or fragment thereof according to embodiment 1.

44. The method of embodiment 42-43, wherein the disease or disorder is selected from the group consisting of obesity, diabetes, dyslipidemia, metabolic diseases, fibrosis, NASH, liver disease, primary biliary cirrhosis, renal disease, kidney fibrosis, chronic kidney disease, osteoporosis, atherosclerosis, cardiovascular disease, cancer, an inflammatory disease, pain, MS spasticity, and ocular diseases, including glaucoma.

45. The method of embodiment 44, wherein the disease or disorder is fibrosis.

46. The method of embodiment 36, wherein the isolated antibody or antigen binding fragment thereof is conjugated to an imaging agent.

47. The method of embodiment 46, wherein the imaging agent is selected from the group consisting of a radiolabel, an enzyme, a fluorescent label, a luminescent label, a bioluminescent label, a magnetic label, and biotin.

48. The method of embodiment 42-43, wherein the cell is present in a subject.

49. The method of embodiment 48, wherein the subject is a human.

50. A host cell expressing the isolated antibody or fragment according to embodiment 1.

51. A method of making an antibody or fragment thereof that specifically binds to CB1, the method comprising immunizing mammals with purified CB1 receptor or an antigenic fragment thereof, CB1/lipid complexes, and/or CB1 receptor DNA.

52. The method of embodiment 51, wherein the antibody or fragment thereof is generated from a hybridoma cell line comprising cells derived from the immunized mammals.

53. The method of embodiment 51, wherein the antibody or fragment thereof is generated from a phage library.

54. A method of making an antibody or fragment thereof that specifically binds to CB1, the method comprising generating a phage library comprising variable heavy and light chain regions from human primary blood lymphocytes and panning the phage library for CB1 receptor binding.

55. An isolated antibody or antigen binding fragment thereof that binds to cannabinoid receptor 1 (CB1), wherein the antibody or antigen binding fragment thereof comprises a heavy chain CDR1, CDR2, and CDR3 according to SEQ ID NOs: 352, 353, and 354, respectively.

56. An isolated antibody or antigen binding fragment thereof that binds to cannabinoid receptor 1 (CB1), wherein the antibody or antigen binding fragment thereof comprises a light chain CDR1, CDR2, and CDR3 according to SEQ ID NOs: 355, 356, and 357, respectively.

57. An isolated antibody or antigen binding fragment thereof that binds to cannabinoid receptor 1 (CB1), wherein the antibody or antigen binding fragment thereof comprises a heavy chain CDR1, CDR2, and CDR3 sequence having at least 80%, at least 85%, at least 90%, at least 95% at least 96%, at least 97%, at least 98%, or at least 99% homology to the amino acid sequence of SEQ ID NOs: 352, 353, and 354, respectively.

58. An isolated antibody or antigen binding fragment thereof that binds to cannabinoid receptor 1 (CB1), wherein the antibody or antigen binding fragment thereof comprises a light chain CDR1, CDR2, and CDR3 sequence having at least 80%, at least 85%, at least 90%, at least 95% at least 96%, at least 97%, at least 98%, or at least 99% homology to the amino acid sequence of SEQ ID NOs: 355, 356, and 357, respectively.

60. An antibody or antigen binding fragment thereof that specifically binds to the same epitope as the antibody or antigen binding fragment according to any one of embodiments listed or disclosed herein.

61. An isolated antibody or antigen binding fragment thereof that binds to cannabinoid receptor 1 (CB1), wherein the antibody or antigen binding fragment thereof comprises: a heavy chain CDR1 comprising an amino acid sequence selected from the group consisting of SEQ ID NOs: 443-463; a heavy chain CDR2 comprising an amino acid sequence selected from the group consisting of SEQ ID NOs: 464-577, and a heavy chain CDR3 comprising an amino acid sequence selected from the group consisting of SEQ ID NOs: 578-625.

61. An isolated antibody or antigen binding fragment thereof that binds to cannabinoid receptor 1 (CB1), wherein the antibody or antigen binding fragment thereof comprises: a light chain CDR1 comprising an amino acid sequence selected from the group consisting of SEQ ID NOs: 626-661; a light chain CDR2 comprising an amino acid sequence selected from the group consisting of SEQ ID NOs: 662-742, and a light chain CDR3 comprising an amino acid sequence selected from the group consisting of SEQ ID NOs: 742-824.

62. The isolated antibody or fragment thereof according to embodiment 1, wherein the antibody or antigen binding fragment thereof is a humanized antibody.

63. The isolated antibody or antigen binding fragment thereof as disclosed herein, wherein the antibody or antigen binding fragment thereof comprises a human IgG1 Fc region.

64. The isolated antibody or antigen binding fragment thereof of any of the preceding embodiments, wherein the antibody or antigen binding fragment thereof comprises a modified Fc region.

65. The isolated antibody or antigen binding fragment of embodiment 64, wherein the antibody or antigen binding fragment thereof comprises an Fc region selected from the group consisting of an IgG2/IgG4 hybrid, an IgG2 comprising A330S and P331S mutations, and an IgG4 comprising an S228P mutation.

66. An isolated antibody or antigen binding fragment thereof that binds to cannabinoid receptor 1 (CB1), wherein the antibody or antigen binding fragment thereof comprises a heavy chain variable region amino acid sequence selected from the group consisting of SEQ ID NOs: 339-341, and, optionally, a light chain variable region according to SEQ ID NO: 337.

67. The isolated antibody or antigen binding fragment of embodiment 66, wherein the antibody or antigen binding fragment thereof comprises a heavy chain constant region according to SEQ ID NO: 342.

68. The isolated antibody or antigen binding fragment of embodiment 66, wherein the antibody or antigen binding fragment thereof comprises a heavy chain amino acid sequence selected from the group consisting of SEQ ID NOs: 343-351, and a light chain amino acid sequence according to SEQ ID NO: 338.

69. An isolated antibody or antigen binding fragment thereof comprising a heavy chain variable region comprising SEQ ID NO: 341 and a heavy chain constant region comprising SEQ ID NO: 433, SEQ ID NO: 434, or SEQ ID NO: 435.

70. An isolated antibody or antigen binding fragment thereof comprising a heavy chain variable region comprising SEQ ID NO: 340 and a heavy chain constant region comprising SEQ ID NO: 433, SEQ ID NO: 434, or SEQ ID NO: 435.

71. An isolated antibody or fragment thereof that comprises a nucleic acid sequence or an amino acid sequence that is at least 65%, at least 70%, at least 75%, at least 80%, at least 85%, at least 90%, at least 95%, or at least 99% identical to an amino acid sequence selected from the group consisting of SEQ ID NOs. 1-351 and SEQ ID NOs. 436-824.

72. An isolated humanized antibody or antigen binding fragment thereof that binds to CB1, wherein the antibody or fragment has a binding affinity Kd for CB1 receptor of about 100 nM or less.

73. The isolated humanized antibody or antigen binding fragment of embodiment 72, wherein the antibody or fragment has a binding affinity Kd for CB1 receptor of about 5 nM or less.

74. An isolated humanized antibody or antigen binding fragment thereof that binds to CB1, wherein the antibody or fragment has CB1 receptor inhibiting activity that is at least 10 fold more potent relative to small molecule rimonabant, wherein the potency is measured by the inhibition of CB1 receptor agonist-mediated signal transduction in a cAMP assay.

75. The isolated humanized antibody or antigen binding fragment of embodiment 74, wherein the antibody or fragment has CB1 receptor inhibiting activity that is at least 5 fold more potent relative to small molecule rimonabant, wherein the potency is measured by the inhibition of CB1 receptor agonist-mediated signal transduction in a cAMP assay.

76. The isolated humanized antibody or antigen binding fragment of embodiment 74, wherein the antibody or fragment has CB1 receptor inhibiting activity that is at least equivalent in potency relative to small molecule rimonabant, wherein the potency is measured by the inhibition of CB1 receptor agonist-mediated signal transduction in a cAMP assay.

77. An isolated humanized antibody or antigen binding fragment thereof that binds to CB1, wherein the antibody or fragment exhibits greater potency than a corresponding non-humanized or chimeric antibody, wherein the humanized antibody or fragment and the corresponding non-humanized or chimeric antibody comprise the same heavy and light chain CDRs, and wherein the potency is measured by the inhibition of CB1 receptor agonist-mediated signal transduction in a cAMP assay.

78. The isolated humanized antibody or antigen binding fragment of embodiment 77, wherein the humanized antibody or fragment has CB1 receptor inhibiting activity that is at least 2 fold more potent relative to the corresponding non-humanized or chimeric antibody or fragment.

79. The isolated humanized antibody or antigen binding fragment of embodiment 78, wherein the humanized antibody or fragment has CB1 receptor inhibiting activity that is at least 3 fold more potent relative to the corresponding non-humanized or chimeric antibody or fragment.

80. The isolated humanized antibody or antigen binding fragment of embodiment 79, wherein the humanized antibody or fragment has CB1 receptor inhibiting activity that is at least 5 fold more potent relative to the corresponding non-humanized or chimeric antibody or fragment.

81. The isolated humanized antibody or antigen binding fragment disclosed herein, wherein the antibody or fragment exhibits reduced or absent brain penetration.

82. The isolated humanized antibody or antigen binding fragment of embodiment 81, wherein the brain penetration of the antibody or fragment exhibits reduced brain penetration relative to a small molecule CB1 receptor agonist or antagonist.

83. The isolated humanized antibody or antigen binding fragment of embodiment 81, wherein the antibody or fragment exhibits reduced central nervous system (CNS) side effects relative to a small molecule CB1 receptor agonist or antagonist.

84. The isolated humanized antibody or antigen binding fragment of embodiment 83, wherein the small molecule CB1 receptor agonist or antagonist is AM6545, AM251, taranabant, or rimonabant.

85. A method of treating a disease or disorder responsive to antagonism or agonism of CB1 receptor in a subject in need thereof, the method comprising administering to the subject an antibody or antigen binding fragment thereof according to any one of embodiments 55-84.

86. The method of embodiment 85, wherein the subject is a human.

87. The method of embodiment 85, wherein the disease or disorder is selected from the group consisting of obesity, diabetes, dyslipidemia, metabolic diseases, fibrosis, NASH, liver disease, primary biliary cirrhosis, renal disease, kidney fibrosis, chronic kidney disease, osteoporosis, atherosclerosis, cardiovascular disease, cancer, an inflammatory disease, pain, MS spasticity, and ocular diseases, including glaucoma.

88. The method of embodiment 85, wherein the antibody or antigen binding fragment exhibits reduced or absent brain penetration.

Although the foregoing invention has been described in some detail by way of illustration and example for purposes of clarity of understanding, it will be readily apparent to one of ordinary skill in the art in light of the teachings of this invention that certain changes and modifications may be made thereto without departing from the spirit or scope of the appended claims. The following examples are provided by way of illustration only and not by way of limitation. Those of skill in the art will readily recognize a variety of non-critical parameters that could be changed or modified to yield essentially similar results.

EXAMPLES

Example 1. Mouse Immunization for Generation of CB1 Receptor Antibodies

The cDNA sequence and primers for cloning of human CB1 receptor were based on pubmed NCBI reference sequence NM_001160258. CB1 receptor was expressed by transient expression with lipofectamine in 293 cells or by generation of stable cell lines. For stable cell line generation, pcDNA4/TO native full length human CB1 receptor construct was transfected into tetracycline inducible system Trex-CHO and Trex-293 cells. Cells were cultured under the antibiotics zeocin and blasticidine. Clones that expressed CB1 upon tetracycline induction were identified by FACS staining with anti-CB1 receptor antibody from R&D (Clone 368302). Membranes were prepared and either used for immunization directly, or following solubilization of membrane proteins in detergent followed by talon purification. Purified CB1 receptor was stabilized in a lipid bilayer. The CB1/lipid complex was designated CB1 receptor iCAPS.

Balb/c mice were immunized for 2 rounds with CB1 receptor DNA followed by boosts with CB1 receptor membranes or CB1 receptor iCAPS. Blood samples were taken pre- and post-immunizations and serum was tested for binding to CB1 receptor expressing membranes versus naïve membranes in ELISAs. Once mouse sera showed a positive signal on CB1 receptor membranes versus naïve membranes, mice were sacrificed and spleens were removed for hybridoma and phage library generation.

Example 2. Recovery of Lymphocytes, B Cell Isolation, Fusion, and Selection of CB1 Receptor Binding Hybridomas Spleens from immunized mice were removed and single cell suspensions generated. To generate single cell suspensions, spleens were transferred to a screen placed on top of a 50 mL conical centrifuge tube, and the plunger of a 3 mL syringe was used to grind the cells out of the spleen. Red blood cells were lysed with ice cold ACK buffer for 10 mins, 5 ml DMEM was added and the cells were centrifuged. This step was repeated once, and cells were resuspended to a concentration of $2\times10^7$/ml in DMEM medium.

Myeloma cell recovery and preparation: SP2/0 cells were seeded at a density of approximately $5\times10^4$ cells/mL and passed every 2 days. Before the cell fusion, parental myeloma cells were harvested by centrifuging in a 50 mL conical centrifuge tube at room temperature (RT) at 500×g for 10 minutes. Cells were washed 3 times by adding 30 mL of serum free medium, and repeated the centrifugation. Supernatant was removed by pipetting and the cell pellet was resuspended in 25 mL of Medium and adjusted to a concentration of $2\times10^7$/ml viable cells.

Cell Fusion: Myeloma cells and spleen cells were mixed at a ratio of 1:5. The cell mixture was spun down at 1000 rpm for 5 mins, and then the supernatant discarded to obtain the cell pellet. Cell mixture was washed twice with fusion working buffer and centrifuged to obtain the cell pellet. The cell pellet was gently resuspended with fusion buffer to a final cell concentration of $8\times10^7$/ml. Cell mixtures were added into the electrode bath and electrofusion performed. The cells were allowed to rest for 5 mins after cell fusion, washed 1× with DMEM medium, and pre-heated HAT medium was added into the fusion cells to a final concentration of $0.5\times10^6$ B cells/ml. Then 100 µl cell suspension ($5\times10^4$ B cells) was added into each well of a 96 well plate. The average fusion efficiency is 1 hybridoma/$1\times10^4$ B cells, so the protocol aims for 5 hybridomas in each well.

Hybridoma cell culture. Fused hybridoma were cultured in cell culture incubator at 5% CO2, 37° C. The hybridoma growth condition was checked daily. The colonies become visible after 5 days normally. Medium was changed with fresh DMEM medium at day 7 before positive screening.

Positive screening: after 7-9 days of cell fusion, when the colony became bigger, 100 µL of supernatant from each hybridoma well was transferred to a separate well on a new 96-well plate and analyzed using ELISA with CB1 protein.

Example 3. Generation and Screening of Phage Libraries

Total RNA extraction: Spleen tissue was harvested in RNAlater. A small piece of frozen tissue (~30 mg) was homogenized in a mortar cooled with liquid N2 and ground into a fine powder. TRIzol® Reagent was added with vigorous shaking by hand for 30 seconds. 1 mL solution was transferred to 1.5 microfuge tubes at room temperature 2-3 min and let stand in room temperature for a few minutes. To the mixture, 0.2 ml chloroform per 1 mL solution was added and shaken vigorously by hand for 30 seconds. The mixture was incubated at room temperature for 5 min and then centrifuged at 12,000×g for 20 min at 4° C. The aqueous phase was removed and transferred to a new tube. An equal volume of isopropyl alcohol was added to the tube and mixed for 30 seconds. After incubating at room temperature for 5 min, the mixture was centrifuged at 12,000 g for 15 min at 4° C. The pellet was washed by adding 500 µl 75% ethanol and centrifugation at 12,000 g for 15 min at 4° C. The resulting total RNA pellet was air dried and dissolved with 50 µl RNase-free water per 1 µg of RNA expected. OD was measured at 260 nm and 280 nm of a 1:10 dilution of the RNA sample.

cDNA prep: First-Strand cDNA Synthesis was done with a commercial kit (Invitrogen, Cat. No: 18080-051), briefly, 20 µg total RNA was mixed with 5 µM oligo(dT)20 and 1 mM dNTP in DEPC-treated water in 40 µl and incubated at 65° C. for 5 min, then 80 µl of RT buffer with 5 mM MgCl2, 10 µM DTT, 16 unit of RNaseOUT and 80 unit of Superscript III reverse transcriptase was added. The resulting mix was incubated at 50° C. for 50 min, and heat inactivated, before 4 µl of RNase H was added to remove residue RNA. The cDNA was used for subsequent library construction.

Chimeric Fab Library was constructed as follows: The variable regions of heavy chain or light chain were amplified by heavy chain or light chain-specific primers representing multiple germline families described in Barbas et al, using the mouse cDNA template prepared above. The human heavy chain and light chain constant region, Ch1 and CL1, respectively, were amplified from an existing clone pCOM3×TT. The heavy chain variable region and constant region were connected together by overlapping PCR. The resulting heavy chain and light chain were connected by overlapping PCR again to obtain the chimeric Fab DNA fragment, which was cloned into a modified pCOM3× vector as SfiI fragment insert by ligation. The ligated library DNA was cleaned and transformed into SS320 high efficiency competent cell. The number of total unique transformants obtained was at least $5 \times 10^7$.

For panning of phage libraries, a phage library from immunized mouse was subtracted twice in Maxisorp immunotubes (Thermo Scientific) coated with empty iCAPS, then subtracted twice with Dynabeads MyOne Streptavidin T1 (Life Technologies) coated with biotinylated Bril protein. All subtraction steps lasted 30 minutes. Meanwhile, biotinylated CB1 receptor iCAPS were coated on Dynabeads MyOne Strepavidin T1 (Life Technologies). The subtracted phage pool and CB1 iCAPS on beads were then mixed, along with un-biotinylated Bril protein and empty iCAPS for competition, and incubated for one hour at room temperature with rotation. Beads were separated from the binding mixture with magnet and washed multiple times to eliminate unbound phage (5 times in Round 1, 10 times each in Round 2 and 3). Bound phage was eluted twice with Glycine buffer pH2.2 for 10 minutes each. The eluates were combined, neutralized with Tris-HCl pH8.0, and used to infect TG1 cells to produce phage for the next round of panning After 3 rounds of panning, single colonies were picked and screened by monoclonal phage ELISA.

For screening of phage binders, single colonies of TG1 infected with panning output were picked into 96-well plates containing 2YT/carbenicillin/glucose medium and shaken overnight at 30 C. The next day, a small volume of saturated culture was transferred to fresh 2YT/carbenicillin/glucose medium and shaken at 37 C until OD600 nm reached 0.6-0.7. Then the culture was infected with KO7 helper phage. The infected TG1 cells were spun down, re-suspended in 2YT/carbenicillin/kanamycin medium and shaken at 30 C overnight. Meanwhile, Maxisorp 96-well plates (Thermo Scientific) were coated with streptavidin (Wako) at 4 C overnight. The third day, biotinylated antigens were captured on streptavidin coated plates, which were then blocked with 3% non-fat milk in PBST. TG1 cells were spun down again. Phage containing supernatants were blocked in 3% non-fat milk and then loaded to the ELISA plates and incubated for one hour at room temperature. After three rounds of washing by PBST, HRP mouse anti-M13 antibody (GE Healthcare) diluted 1:2000 in 3% non-fat milk in PBST was added to the plates and incubated for another hour at room temperature. The plates were washed three times with PBST, then developed with TMB (Biopanda). HCl was added to the plates to stop the reaction. Absorbance at 450 nm was read on Emax precision microplate reader (Molecular Devices). Clones that bound to iCAPS specifically were picked for further characterization and sequencing.

*E. coli* colonies harboring plasmids that produce Fab displayed on phage were recovered. Plasmid DNA was extracted and sequenced to obtain the Fab DNA information. Specific primers were designed to amplify the V region of heavy chain, the PCR product was cloned into pTT5-HCV3, a modified version of pTT5 expression vector, previously treated with ApaI and SacI restriction enzymes, in front of the human heavy constant region by seamless cloning. Specific primers were also designed to amplify the entire light chain region of Fab fragment. The resulting PCR fragment was cloned into pTT5-IL2-LCC, a modified pTT5 vector, treated with EcoRI and NotI by seamless cloning. The resulting 2 plasmids were sequence-verified.

Example 4. Hybridoma Sequencing

Hybridoma cells ($1 \times 10^7$) were harvested and total RNA was extracted using Tri Reagent as described above for spleen tissue. cDNA was prepared using SuperScript III kit according to the manufacturer's instruction, described above. The resulting cDNA product was used as template for PCR with primers VhRevU and VhForU, the resulting 300 bp PCR product was cleaned up using a PCR clean-up kit and sequenced with the same primer. PCR reaction was also performed with light chain V-region specific primer VkRev7 and VkFor (for variable region only) or KappaFor primers (for entire kappa light chain). Sequencing reactions were performed on cleaned PCR product to obtain DNA sequence.

Example 5. Expression and Analysis of IgG

IgG expression: Two pTT5-based plasmids, one containing the Heavy chain and the other containing the light chain DNA, were co-transfected into HEK293F cells for IgG expression. 24 hours prior to transfection, 293F cells were diluted to the density of $8 \times 10^5$ cells/ml. On the day of transfection, cells were maintained at $1.1$-$1.3 \times 10^6$ cells/ml. One µg of plasmid DNA was used for transfection of 1 ml cell suspension culture. 80 µg of DNA were diluted into 4 ml of fresh 293F freestyle medium. 240 µg of the transfection reagent Polyethylenimine (PEI) were diluted into a final volume of 4 ml 293F freestyle medium. After 3 minutes incubation, 4 ml DNA were mixed thoroughly with 4 ml PEI. The 8 ml of DNA and PEI mixture were incubated for 15 minutes at room temperature and slowly added into 80 ml of 293F cells suspension culture. Cells were incubated at an orbital shaking platform at a speed of 130 rpm at 37° C. with 5% CO2 and harvested in 4 days.

IgG purification: 0.4 ml bed volume of Protein A were placed into a 1 mL column and washed with 10 mL of dH2O and 10 ml of pH 8.0 PBS. Transfected 293F cells suspensions were spun down at 4000 rpm for 45 minutes at 4° C. The pellets were discarded and the supernatant was adjusted to pH 8.0 on ice and loaded into the prepared Protein A column. When the supernatant loading was finished, the column was washed with 5 ml of pH 8.0 PBS and eluted with 4 ml of 0.1 M Na Citrate-HCl pH3.5. The elution containing IgGs was neutralized with 200 µl pH 8.8 1.5M Tris-HCl buffer and concentrated with a 30 kD 4 ml concentrator. 4.5 ml of PBS were filled up the concentrator and spun down. Finally, IgGs were exchanged and stored into PBS. The IgGs were detected by OD280 and the purity was determined by SDS-PAGE gel and SEC.

The concentrations, volumes, and yields of PA13R3-P1C4 achieved in four different experiments are shown in Table 4. The concentrations, volumes, and amounts of various clones are shown below in Table 5.

TABLE 4

PA13R3-P1C4 expression

| Name | Concentration (mg/ml) | Volume (µl) | Amount (µg) | Yield (mg/L) |
|---|---|---|---|---|
| PA13R3-P1C4 | 0.3 | 200 | 60 | 0.75 |
| PA13R3-P1C4 | 1.01 | 500 | 505 | 3.2 |
| PA13R3-P1C4 | 0.49 | 500 | 245 | 1.5 |
| PA13R3-P1C4 | 1.25 | 1250 | 1562.5 | 3.9 |

TABLE 5

Expression of clones

| Clone | Concentration (mg/ml) | Volume (µl) | Amount (µg) |
|---|---|---|---|
| PA13R3-P1C4 (functional) | 0.3 | 200 | 60 |
| PA2LR3-P2D3 | 0.31 | 250 | 77.5 |
|  | 0.18 | 200 | 36 |
| PA2LR3-P1G6 | 1.99 | 350 | 696.5 |
| PA2LR3-P3B10 | 0.23 | 600 | 138 |
|  | 0.64 | 200 | 128 |
| PA2R3-P1A7 | 1.93 | 400 | 772 |
|  | 3.1 | 300 | 930 |
|  | 0.06 | 250 | 15 |
|  | 1.07 | 1200 | 1284 |
| PA2LR3-P1H4 | 1.94 | 300 | 582 |
| PA2LR3-P4B1 | 1.62 | 250 | 405 |
|  | 0.98 | 200 | 196 |
| PA2LR3-P4B5 | 0.8 | 200 | 160 |
|  | 0.85 | 450 | 382.5 |
|  | 0.61 | 200 | 122 |
|  | 1.68 | 600 | 1008 |
| PA2LR3-P4G10 | 1.32 | 250 | 330 |
| PA2LR3-P4C6 | 1.63 | 250 | 407.5 |
|  | 0.56 | 250 | 140 |
| PA2LR3-P3B8 | 4.13 | 250 | 1032.5 |
| PA2LR3-P2B8 | 1.01 | 550 | 555.5 |
|  | 1.78 | 500 | 890 |
|  | 1.1 | 500 | 550 |
|  | 3.3 | 900 | 2970 |
| PA2LR3-P2E5 | 0.47 | 550 | 258.5 |
| PA2R3-P1F1 | 0.8 | 500 | 400 |
| PA2LR3-P3A8 | 1.65 | 200 | 330 |
| PA2LR3-P3F8 | 1.97 | 150 | 295.5 |
| PA2LR3-P5E7 | 0.74 | 250 | 185 |

TABLE 5-continued

Expression of clones

| Clone | Concentration (mg/ml) | Volume (µl) | Amount (µg) |
|---|---|---|---|
| PA2LR3-P6B12 | 2.45 | 200 | 490 |
| PA2LR3-P6G7 | 0.92 | 200 | 184 |

Example 6. Binding of IgG to CB1 iCAPS by ELISA

Purified IgG was tested for binding to purified CB1 receptor (CB1 Conformation Antigen Presenting System (iCAPS)) by ELISA. Non-biotinylated antigens (e.g. empty iCAPS) were coated directly on Maxisorp plates. The primary antibodies were purified IgGs with 1:3 serial dilutions, incubated on the plate for 1 hour. After 3 rounds of washing with PBST, secondary antibodies HRP goat anti-mouse IgG (Abmart) or HRP goat anti-human IgG (Sigma), depending on the species of the IgGs were added and incubated for another hour. The plates were washed three times with PBST, then developed with TMB (Biopanda). HCl was added to the plates to stop the reaction. Absorbance at 450 nm was read on Emax precision microplate reader (Molecular Devices). Binding data is summarized in Table 6.

TABLE 6

Binding to CB1 iCAPS

| Clone | A139 EC50 (nM) | A138 EC50 (nM) |
|---|---|---|
| PA2LR3-P1G6 | 35 | 81 |
| PA2LR3-P1H4 | 33.52 | 21.04 |
| PA2LR3-P2B8 | 1.8 | 6.7 |
| PA2LR3-P2D3 | 2.6 | 4.9 |
| PA2LR3-P2E5 | 3.2 | 10 |
| PA2LR3-P3B10 | 0.78 | 1.4 |
| PA2LR3-P3B8 |  | 71 |
| PA2LR3-P4B1 | 1.406 | 1.277 |
| PA2LR3-P4B5 | 0.24 | 0.24 |
| PA2LR3-P4C6 | 0.4 | 0.4 |
| PA2LR3-P4G10 | 1.354 | 1.189 |
| PA2R3-P1A7 | 3.5 | 7.5 |
| PA2R3-P1F1 | 1.1 | 1.3 |
| PA13R3-P1C4 | 0.175 | 0.1719 |

Example 7. Binding of IgG by FACS

TRex CHO parental cells, TRex CHO A56 over-expressed CB1 (CB1 T210A/fusion partner), and Native human CB1 TRex CHO A156 were harvested from flasks. 100 µl of $1\times10^6$ cells/ml of cells were incubated with primary antibody IgGs. Secondary Antibody PE conjugated anti-human and anti-mouse was diluted in 1:200 folds. Anti-Human Fab FITC was diluted in 1:32 folds. Cells were washed with 200 µl of FACS buffer twice and transferred to BD 5 ml Falcon tube and analyzed by flow cytometry. Binding of purified IgG was initially tested at concentrations of 30 nM and 300 nM. A number of binders were identified as shown in FIG. 1A-1F.

To further assess TRex CHO parental cells, TRex CHO A56 overexpressed CB1, Native human CB1 TRex CHO A156, 5HT2B, Mouse CB1 and human CB2 were used to examine the specificity of IgG binding. 100 µl of $1\times10^6$ cells/ml of cells were incubated with primary antibody IgGs in 3-fold serial dilutions starting from 1 µM to 0.5 nM for 30 minutes on ice. After being washed with 200 µl of FACS buffer twice, cells were incubated with secondary antibody for 30 minutes on ice. Cells were washed with 200 µl of FACS buffer twice and transferred to BD Falcon 5 ml tube and analyzed by FACS.

Santa Cruz anti-CB1 rabbit polyclonal antibody and secondary antibody FITC conjugated anti-rabbit were used to detect the expression of mouse CB1. R&D mouse monoclonal anti-CB2 and human IgG P2C2 were used to confirm the expression of CB2 and 5HT2B respectively. Both anti-mouse and anti-human secondary antibodies were PE-conjugated.

Figure 2:
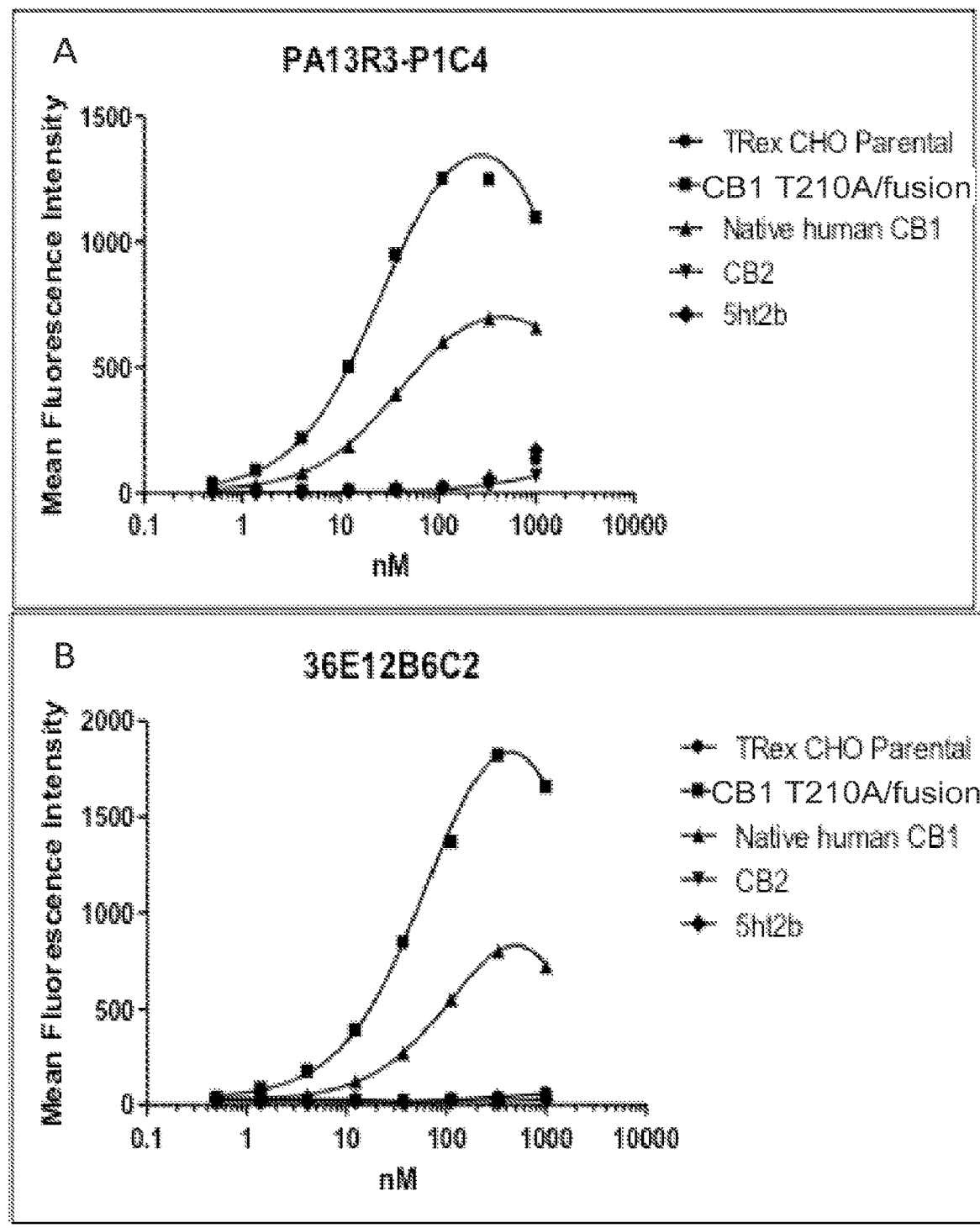
FIG. 2 shows the selectivity of two of the CB1 receptor antibodies, PA13R3-P1C4 and 36E12B6C2, for binding to cells expressing CB1.
Figure 2C:
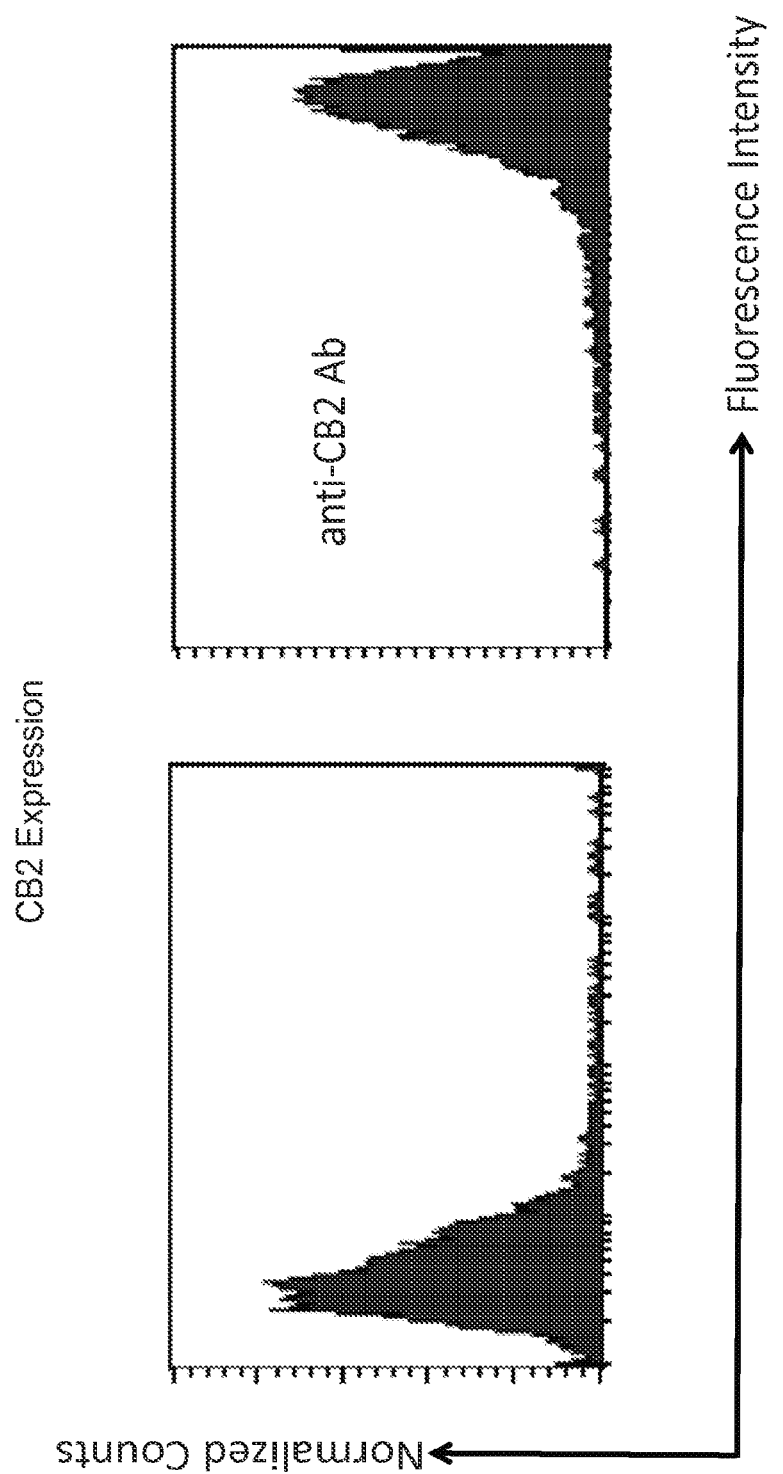
FIG. 2A (showing PA13R3-P1C4 binding) and FIG. 2B (showing 36E12B6C2 binding) show that both antibodies bound to A156 (native human CB1 receptor expressing) and, to an even greater extent, A56 (over-expresses CB1 receptor modified by T210A mutation and ICL3 replacement with fusion partner fusion partner) but did not exhibit binding to non-CB1 receptor expressing CHO cells, CB2 expression cell line, or 5HT2b expression cell line. Expression of CB2 (FIG. 2C) and 5HT2b (FIG. 2D) was confirmed in CB2 expression and 5HT2b expression cell lines, respectively.
Figure 2D:
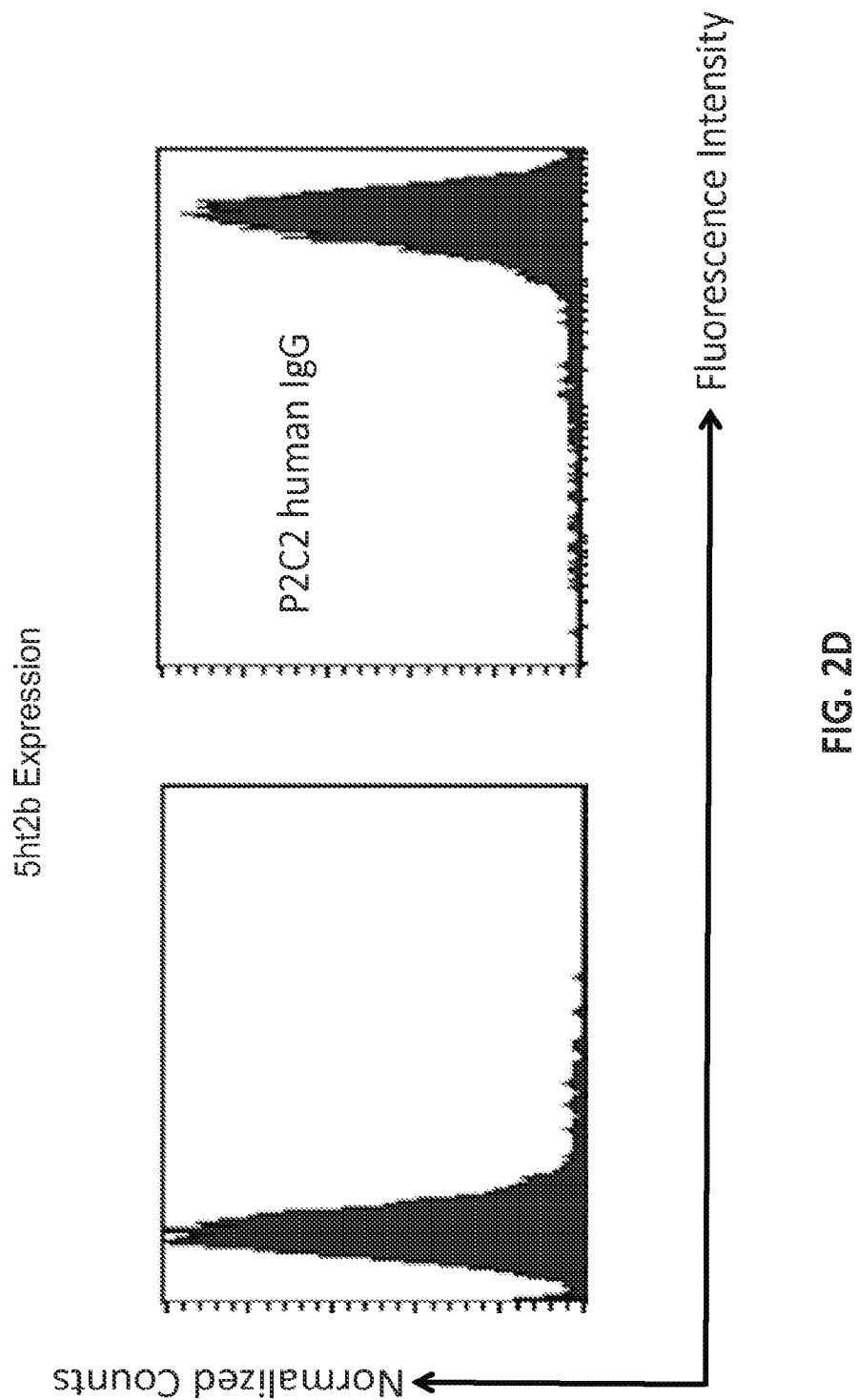

For selected binders, full binding curves were generated on CB1 receptor by testing a range of concentrations. Three-fold serial dilutions from 1 µM to 0.1 µM were prepared. Selectivity was determined by measuring binding to cells expressing 5HT2B or CB2, relative to binding to A156 (native human CB1 receptor expressing) or A56 (overexpressed—CB1 receptor with the T210A modification and ICL3 replacement with fusion partner) by flow cytometry. As shown in FIG. 2C and FIG. 2D, the expression of CB2 and 5HT2B was confirmed using mouse monoclonal anti-CB2 and P2C2 human IgG to confirm CB2 and 5HT2B expression, respectively. PE-conjugated anti-mouse (for detection of anti-CB2) and PE conjugated anti-human antibodies were used to detect CB2 and 5HT2B, respectively. Antibodies PA13R3-P1C4 and 36E12B6C2 bound selectively to CB1, as shown in FIG. 2A and FIG. 2B. In addition, Table 7 shows the concentrations and disassociation constants (Kd) for each of several batches of PA13R3-P1C4 and 36E12B6C2.

The results of the study showed that PA13R3-P1C4 IgG and Fab and 36E12B6C2 bind to both A56 and A156 but not parental TRex CHO and they do not have cross-activity with 5ht2b, human CB2 or Mouse CB1.

TABLE 7

Flow cytometry results for various batches of antibodies

| IgG | Concentration | Cell line | Kd |
|---|---|---|---|
| PA13R3-P1C4 | 1.01 mg/ml | A156 | 40.54 nM |
| PA13R3-P1C4 | 1.01 mg/ml | A156 | 171 nM |
| PA13R3-P1C4 | 0.49 mg/ml | A156 | 187 nM |
| PA13R3-P1C4 | 1.25 mg/ml | A156 | 72.6 nM |
| 36E12B2E5 | 4 mg/ml | A156 | 37.4 nM |
| 36E12B2H8 | 7.05 mg/ml | A156 | 25.89 nM |
| 36E12B6C2 | 4.85 mg/ml | A156 | 63.95 nM |
| 36E12B6F2 | 5.57 mg/ml | A156 | 61.87 nM |
| 36E12B6C2 | 5.78 mg/ml | A156 | 151.1 nM |
| 36E12B6C2 | 5.9 mg/ml | A156 | 25.97 nM |
| 36E12B6C2 | 5.28 mg/ml | A156 | 27.66 nM |
| PA13R3-P1C4 | 1.01 mg/ml | A56 | 27.3 nM |
| PA13R3-P1C4 | 1.25 mg/ml | A56 | 50.59 nM |
| 36E12B2E5 | 4 mg/ml | A56 | 30.95 nM |
| 36E12B2H8 | 7.05 mg/ml | A56 | 20.34 nM |
| 36E12B6C2 | 4.85 mg/ml | A56 | 29.32 nM |
| 36E12B6F2 | 5.57 mg/ml | A56 | 23.91 nM |
| 36E12B6C2 | 5.78 mg/ml | A56 | 69.42 nM |
| 36E12B6C2 | 5.9 mg/ml | A56 | 60.24 nM |
| 36E12B6C2 | 5.28 mg/ml | A56 | 51.94 nM |

Example 8. Competition Assay

TRex CHO A156 Native human CB1 cells were used to test whether 36E12B6C2 and P1C4 bind to similar epitopes. Concentrations at EC80 and EC50 of P1C4 and 36E12B6C2 were used for staining. Excess of PA13R3-P1C4 IgG, Fab and 36E12B6C2 were used for competition. 100 µl of 1×10$^6$ cells/ml of A156 cells were incubated with competitor IgGs for 30 minutes on ice and then staining IgGs were added into the mixture with 30 minutes incubation on ice. After being washed with 200 µl of FACS buffer twice, cells were incubated with secondary antibody for 30 minutes on ice. PE conjugated anti-human and anti-mouse was diluted in 1:200 folds. Cells were washed with 200 µl of FACS buffer twice and transferred to BD Falcon 5 ml tube and analyzed by FACS.

Figure 3A:
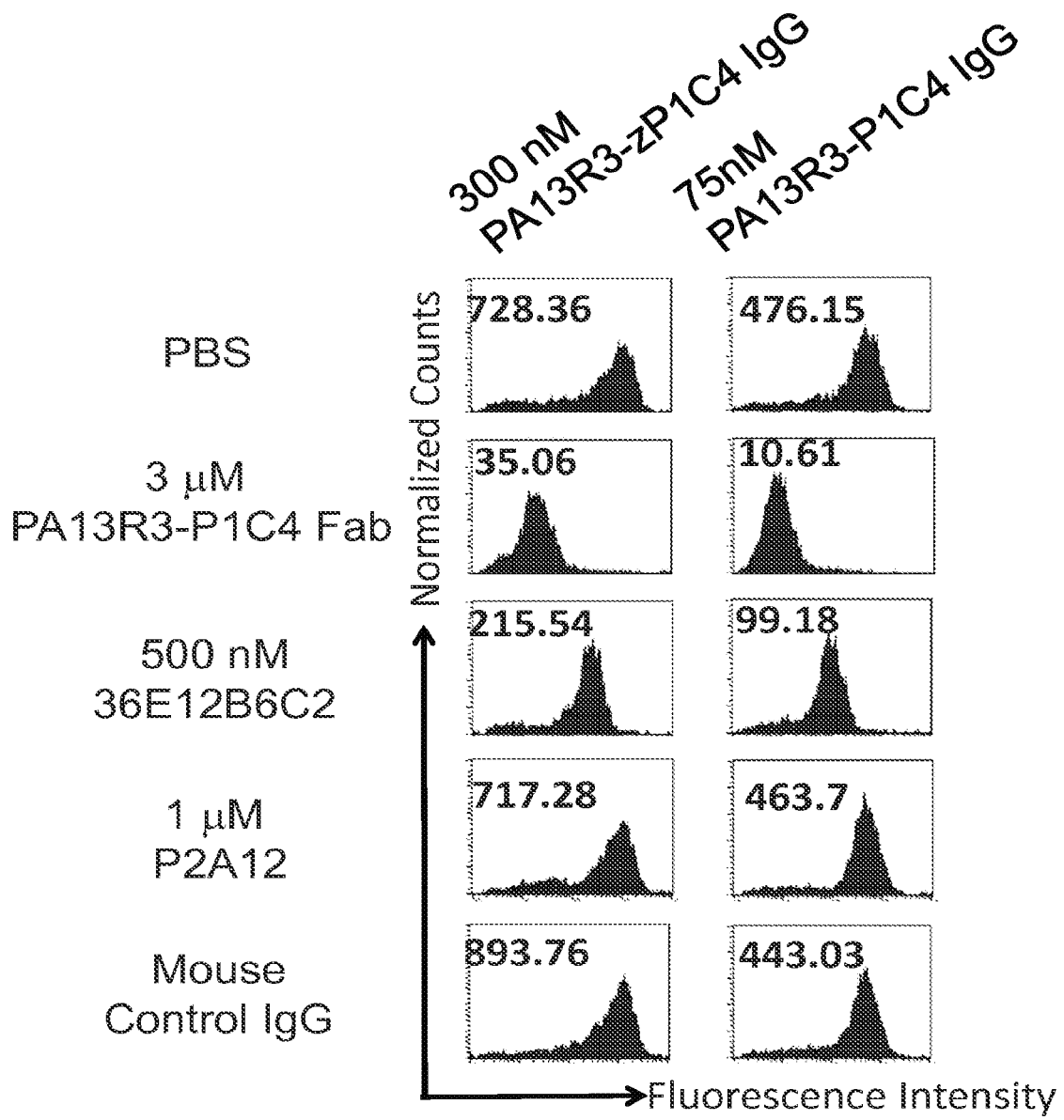
FIG. 3 shows the results of a competition assay to determine if 36E12B6C2 and P1C4 bind to similar epitopes. Trex CHO A156 native human CB1 cells were incubated with competitor IgGs (PA13R3-P1C4 IgG or Fab and 36E12B6C2) followed by different concentrations of staining IgGs (300 nM or 75 nM of P1C4, FIG. 3A; 80 nM or 25 nM of 36E12B6C2, FIG. 3B).
Figure 3B:
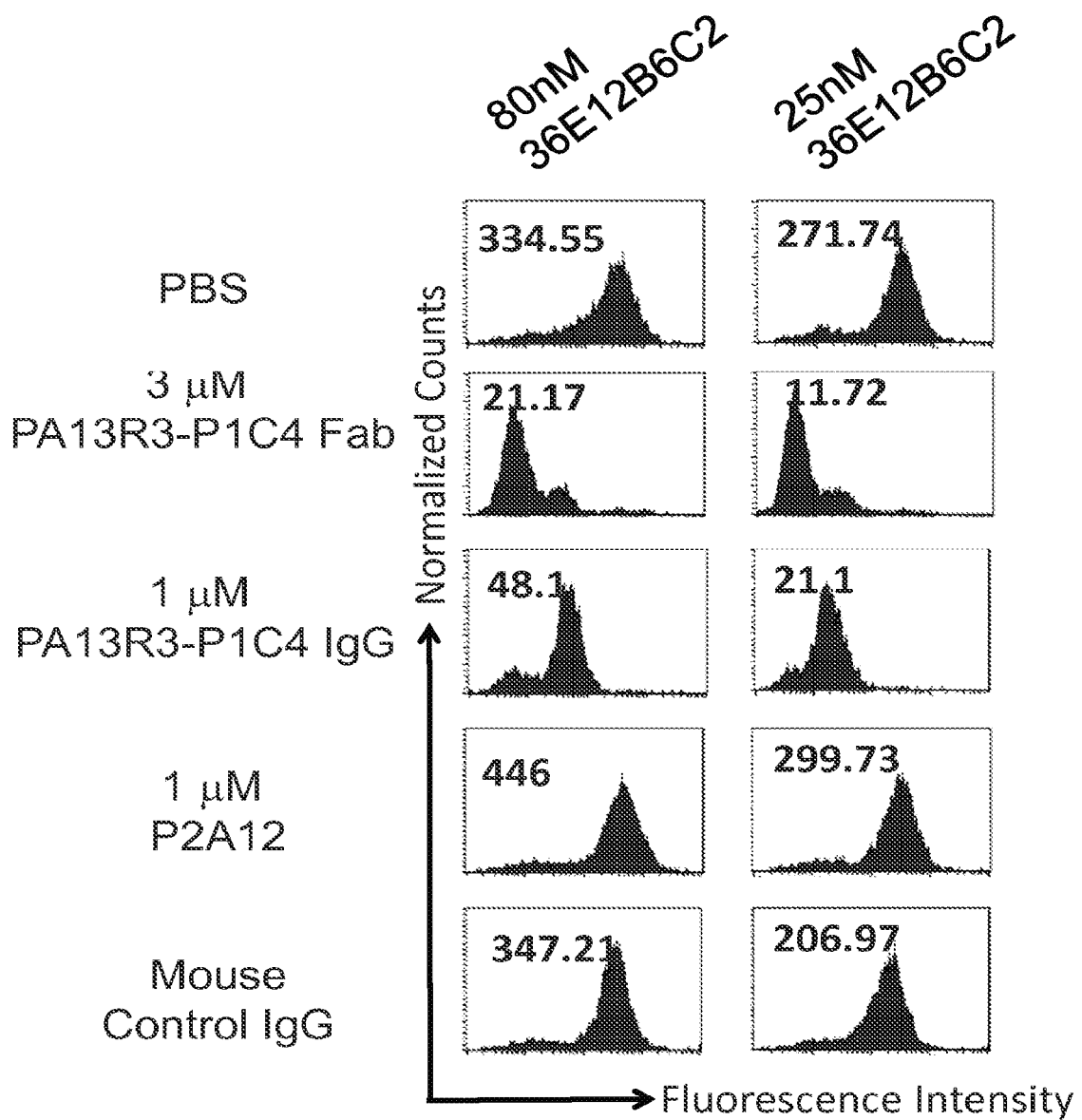

The results of the study showed that PA13R3-P1C4 Fab and IgG competed with 36E12B6C2 for CB1 binding, suggesting PA13R3-P1C4 and 36E12B6C2 bind to overlapping epitopes (FIGS. 3A and B). The competitor 36E12B6C2 brought up from 100 nM to 500 nM could also compete with PA13R3-P1C4 for binding to CB1.

Example 9. cAMP Functional Assay

A cAMP functional assay was performed to measure the antagonism of the antibodies. The cAMP functional assay (Cisbio) was performed on white 384-well low volume plate (Greiner). 8000 cells/well of stably expressed CB1 TRex CHO cells were seeded to the plate followed by incubating antagonist at various concentrations (ranging from 10 µM to 0 µM) at room temperature for 10 min. 5 µM of forskolin (Sigma Aldrich) and 9 µM of the cannabinoid CP55940 (Sigma Aldrich) were added to the cell stimulation mixture to and incubated for 30 min at room temperature to activate CB1. After 30 min incubation, 5 µL of cAMP-d2 (1:39 dilution with conjugate and lysis buffer provided by Cisbio) and 5 µL of anti-cAMP cryptate (1:9 dilution with conjugate and lysis buffer provided by Cisbio) were added to the cell stimulation and incubated for an hour. FRET signal was detected with Envision multilabel plate reader (Perkin Elmer) at anti-cAMP cryptate excitation at 620 nm and emission at 665 nm. Data analysis was performed using GraphPad Prism.

Figure 4:
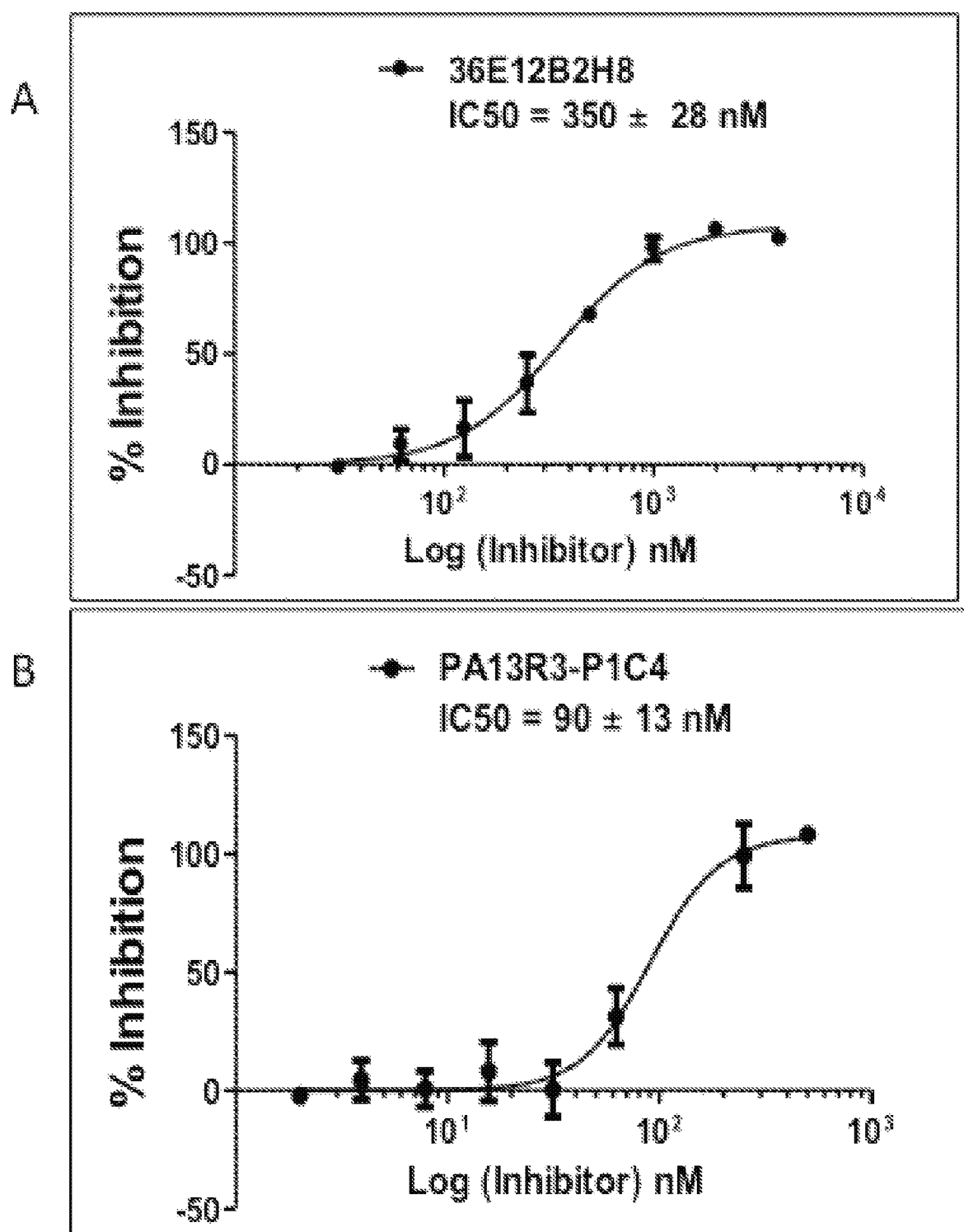
FIG. 4 shows the results of the cAMP functional antagonist assay. Antibodies 36E12B2H8 (FIG. 4A) and PA13R3-P1C4 (FIG. 4B) exhibited antagonistic activity that was equipotent (36E12B2H8) or more potent (PA13R3-P1C4) relative to positive control small molecule CB1 receptor inhibitors AM251 (FIG. 4C), SR141716A (rimonabant) (FIG. 4D), and AM6545 (FIG. 4E). P2A12 and hybridoma IgG isotype were used as negative controls (FIGS. 4F and 4G).
Figure 4:
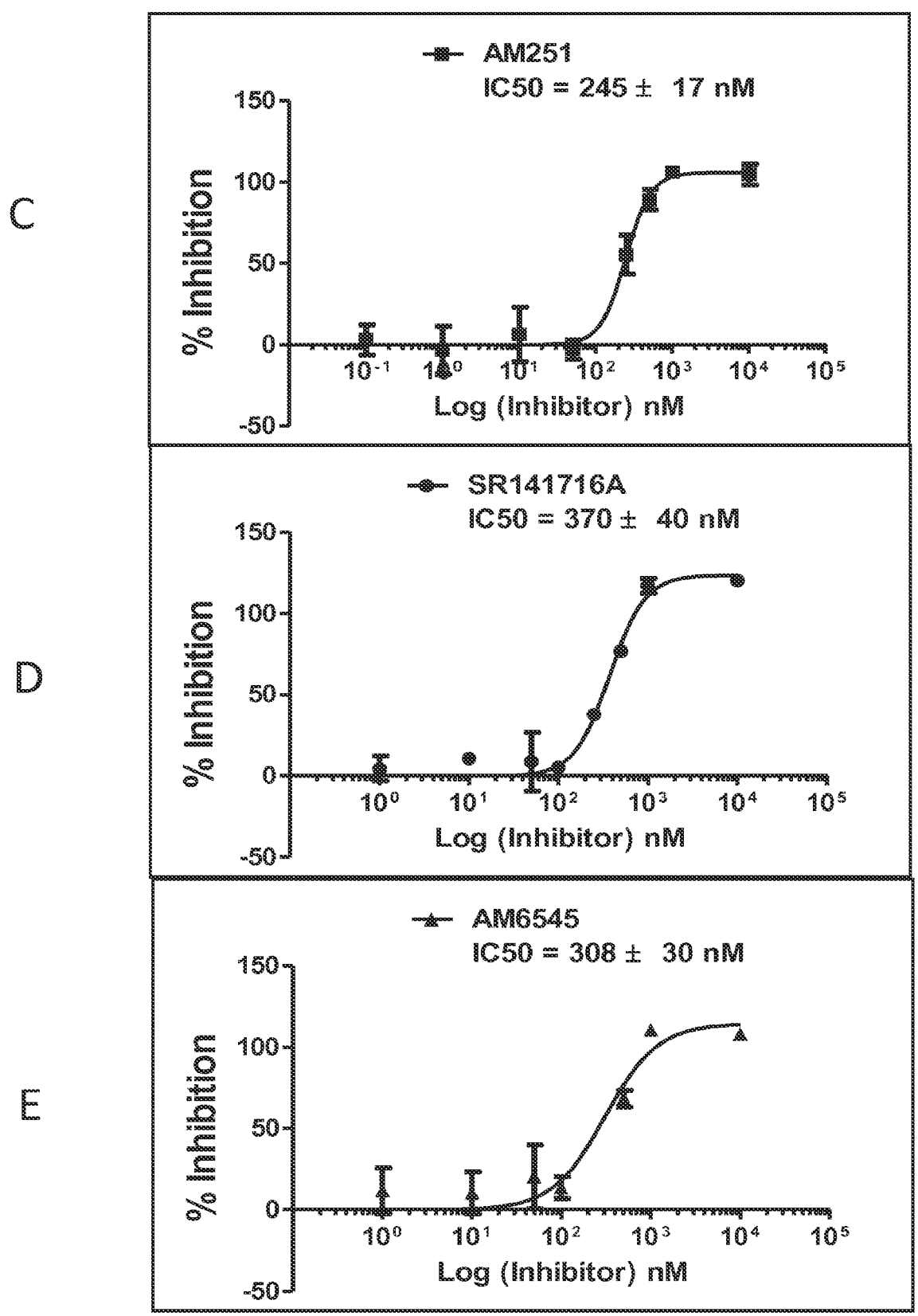
Figure 4:
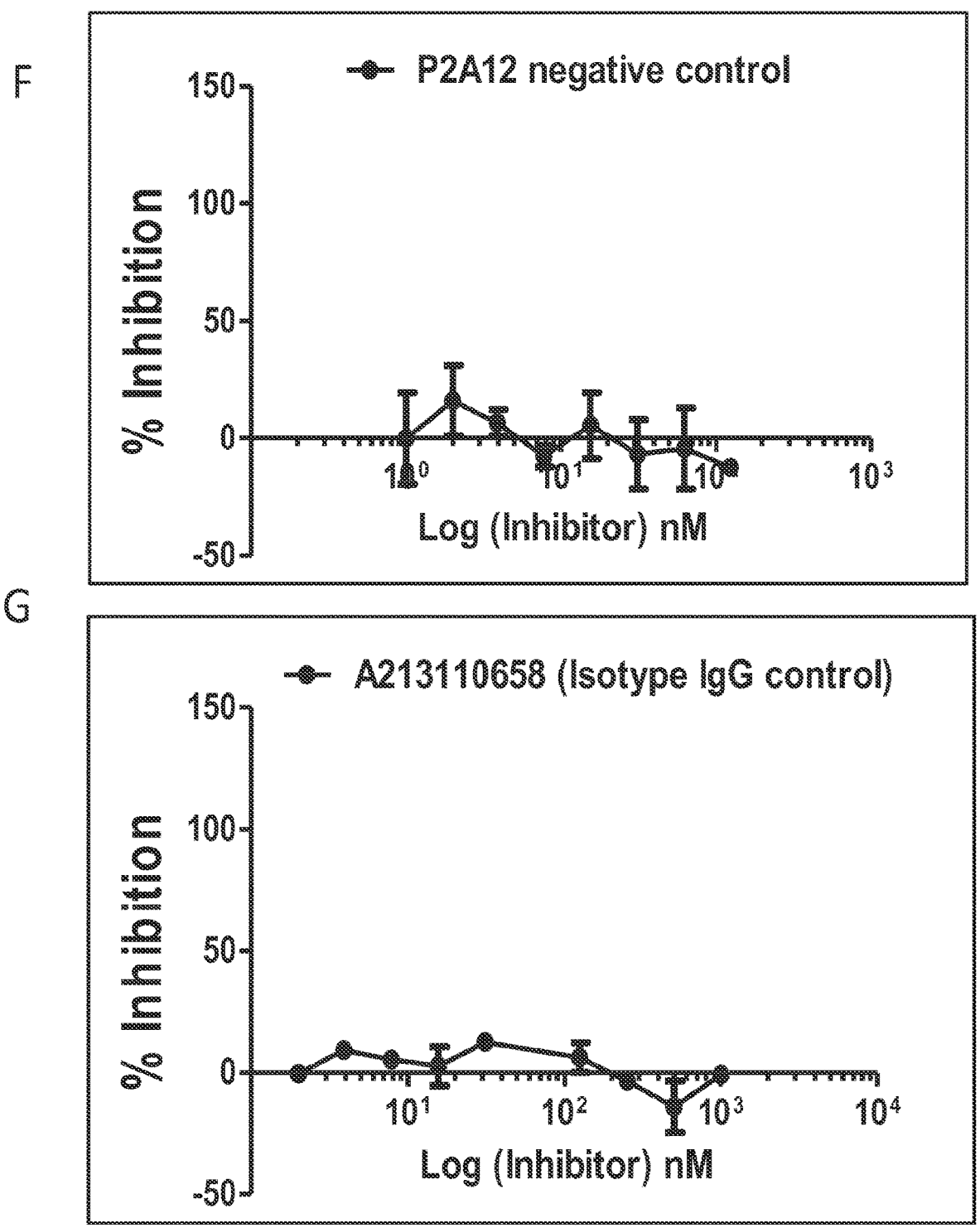

As shown in FIG. 4, two antibodies, 36E12B2H8 (hybridoma) and PA13R3-P1C4 (phage derived) exhibited antagonistic activity equipotent (36E12B2H8) or more potent (PA13R3-PIC4) than the small molecule positive controls (inverse CB1 receptor agonists SR141716A (rimonabant) and AM251, and neutral antagonist AM6545) with IC50 values of 350±28 nM and 90±13 nM, respectively.

Example 10: ERK Activation Assay

To further confirm antagonist activity of mAbs, ERK activation as part of the CB1 receptor signaling pathway was assessed. Two days before the experiment, Trex-CHO CB1 receptor cells were seeded at 500,000 cells/well into 6-well plates. 1 µg/mL tetracycline was used to induce CB1 receptor expression after 24 hours. Cells were serum starved for at least two hours before the experiment. Purified IgGs at 300 nM were added to the culture media, after 30 minutes, cells were stimulated with CB1 receptor agonist WIN55,212 (100 nM) for 10 and 15 minutes. Cell lysates were harvested and the level of ERK activation was determined by western blot. Anti-ERK and Anti-phospho-specific ERK antibodies were obtained from Cell Signaling Inc.

Figure 5A:
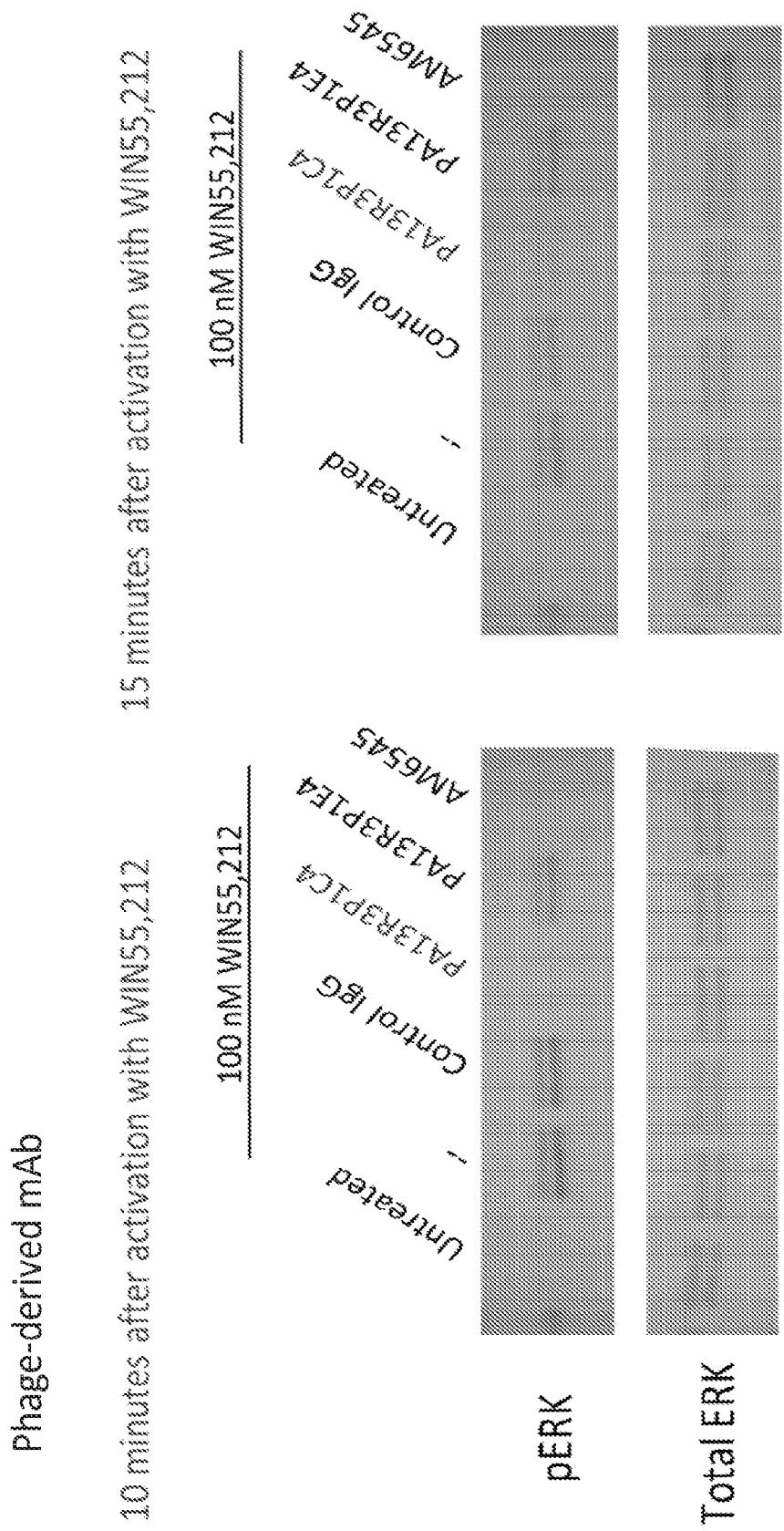
FIG. 5A is a set of Western blots showing phosphorylated ERK (pERK) and total ERK in Trex-CHO native human CB1 receptor cells following CB1 receptor expression and treatment with control IgG, positive control small molecule AM6545, or phage derived mAb PA13R3-P1C4 or PA13R3-P1E4, followed by treatment with 100 nm of CB1 receptor agonist WIN55,212. The Western blots shown are from 10 minutes following WIN55,212 activation (left panels) or 15 minutes following WIN55,212 activation (right panels).

Treatment with CB1 receptor agonist WIN55,212 induced ERK activation as demonstrated by the increase in phosphorylated ERK signal. Total ERK was used as western blot loading control to show equal loading of the samples. As shown in FIG. 5A, phage-derived antibody PA13R3-P1C4

Figure 5B:
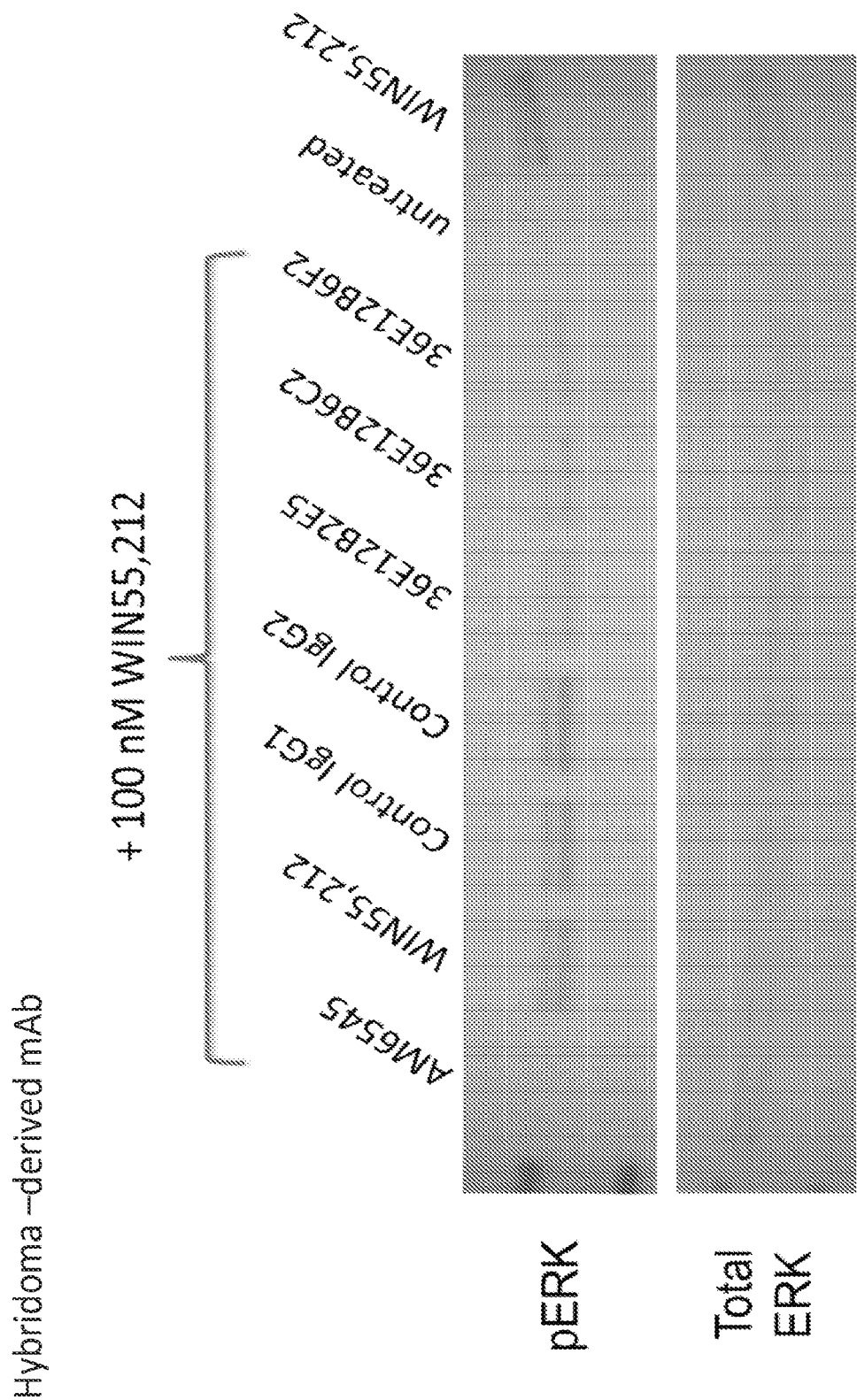
FIG. 5B is a set of Western blots showing pERK and total ERK in Trex-CHO native human CB1 receptor cells following CB1 receptor expression and treatment with control IgG1, control IgG2, WIN55,212, AM6545, or hybridoma-derived mAb 36E12B2E5, 36E12B6C2, or 36E12B2F2, followed by WIN55,212 activation.

(300 nM) but not control IgG (irrelevant binder) or PA13R3-P1E4, blocked WIN55,212 (100 nM) induced ERK phosphorylation. As shown in FIG. 5B, hybridoma-derived antibodies 36E12B2E5, 36E12B6C2, and 36E12B6F2, but not control IgG, blocked WIN55,212 induced ERK phosphorylation. AM6545 (neutral antagonist) was used as positive control as shown in both FIGS. 5A and 5B.

Example 11. cAMP Functional Assays

The cAMP agonist functional assay (Cisbio) was performed on white 384-well low volume plate (Greiner). 8000 cells/well of stably expressed CB1 TRex CHO cells were seeded to the plate followed by incubating agonist at various concentrations (ranging from 1.5 µM to 0 µM) at room temperature for 10 min. To test for agonist activities (FIGS. 6A and 6B), 5 µM of forskolin (Sigma Aldrich) was added to the cell stimulation mixture and incubated for 30 min at room temperature. To assess for positive allosteric modulator activity (FIGS. 6C and 6D), 5 µM of forskolin (Sigma Aldrich) and 1 µM of CP55940 were added to the cell stimulation mixture and incubated for 30 min at room temperature.

After 30 min incubation, 5 µL of cAMP-d2 (1:39 dilution with conjugate and lysis buffer provided by Cisbio) and 5 µL of anti-cAMP cryptate (1:9 dilution with conjugate and lysis buffer provided by Cisbio) were added to the cell stimulation and incubate for an hour. FRET signal was detected with Envision multilabel plate reader (Perkin Elmer) when anti-cAMP cryptate excitation at 620 nm and emission at 665 nm. Data analysis was performed using GraphPad Prism software.

Figure 6A:
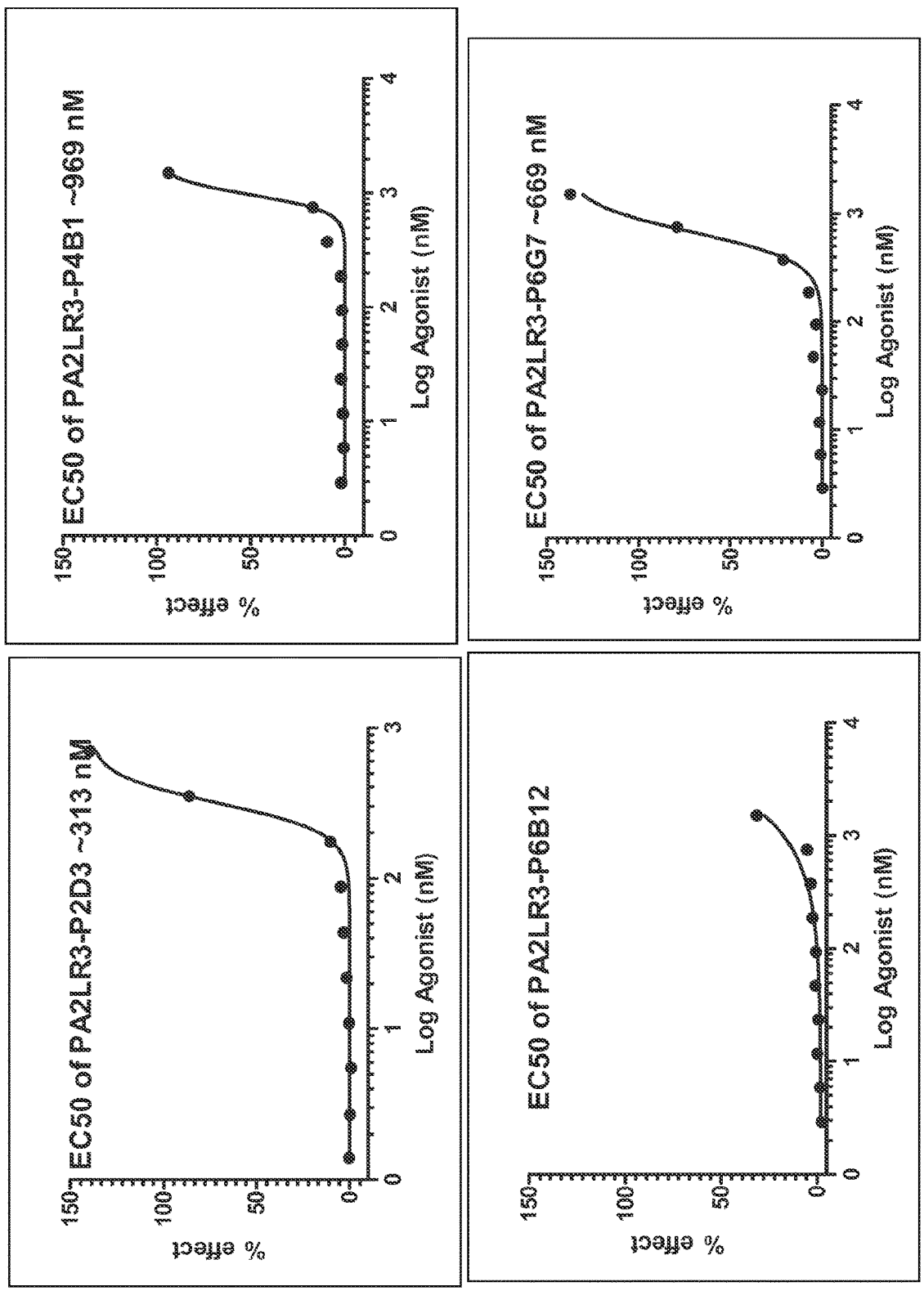
FIG. 6A shows the results of the cAMP functional assay performed in the absence of CP55940 to assess potential agonist activity of PA2LR3-P2D3, PA2LR3-P4B1, PA2LR3-P6B12, and PA2LR3-P6G6, relative to controls depicted in FIG. 6B: CP55940 (positive control), P2A12 (negative control), or PA2R3-P1A7 (negative control).
Figure 6B:
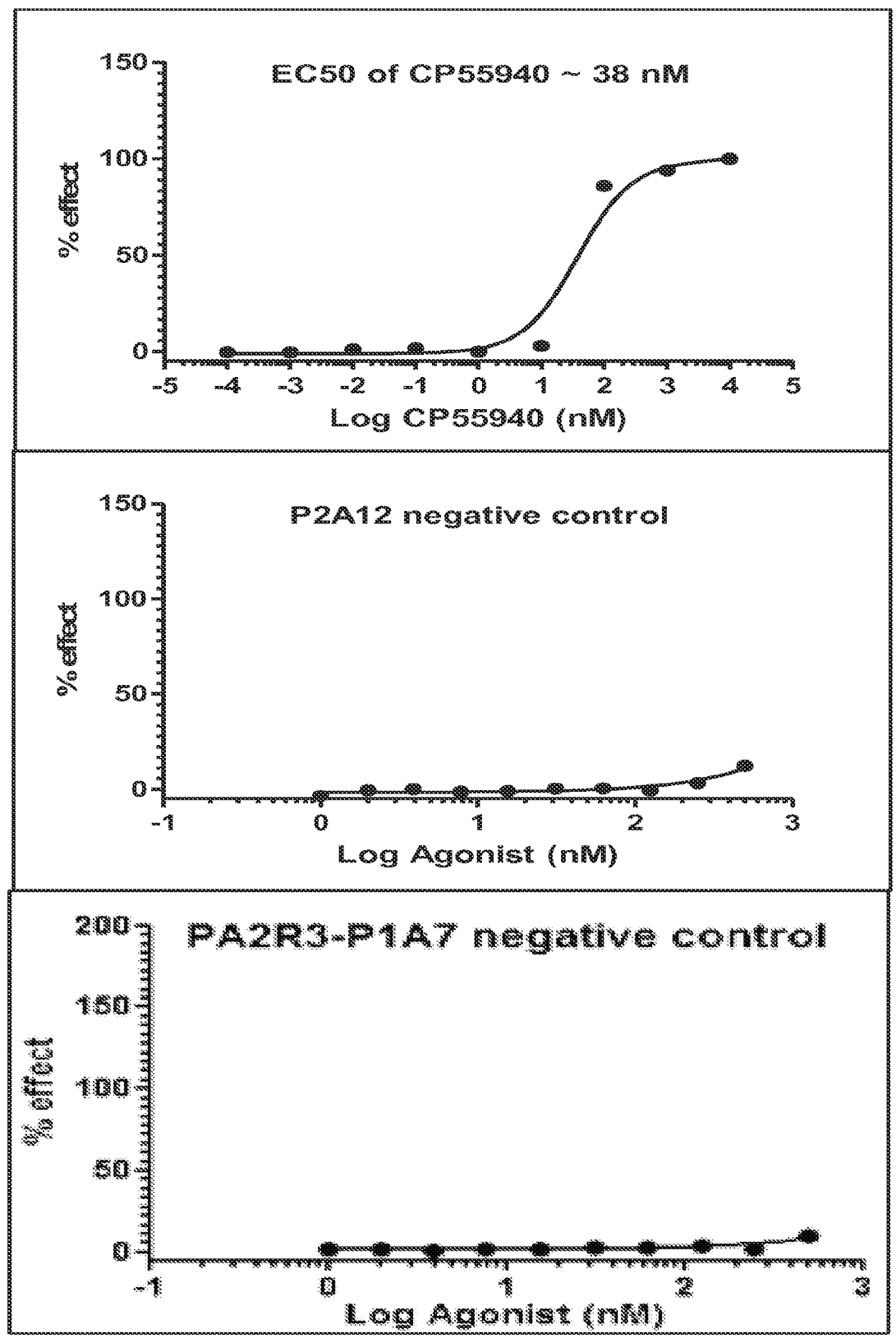
FIG. 6C shows the results of the cAMP functional assay performed in the presence of CP55940 to assess potential allosteric modulator activity of PA2LR3-P2D3, PA2LR3-P4B1, PA2LR3-P6B12, and PA2LR3-P6G6, relative to controls depicted in FIG. 6D: CP55940 alone (positive control), P2A12 (negative control), or PA2R3-P1A7 (negative control).
Figure 6C:
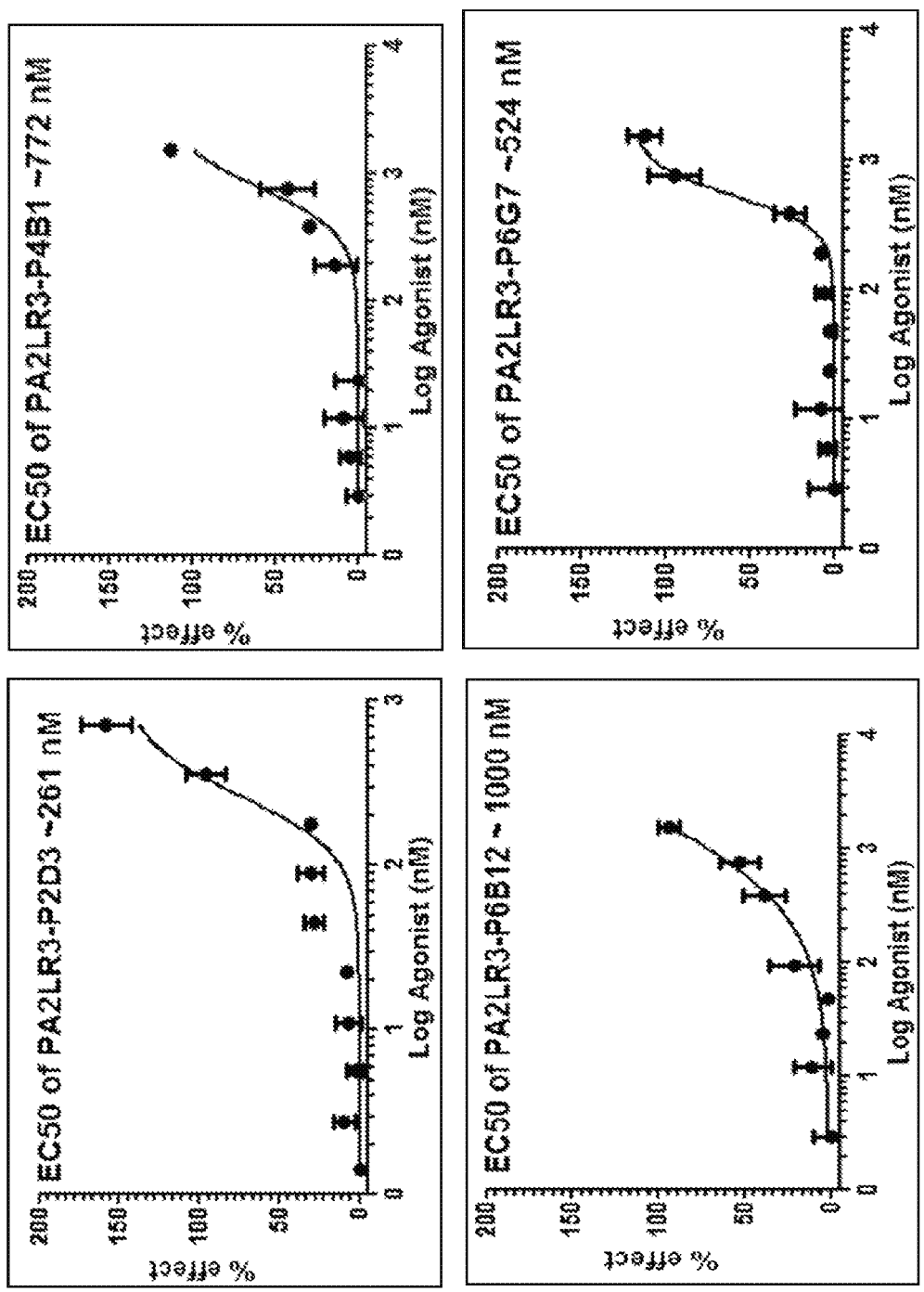
Figure 6D:
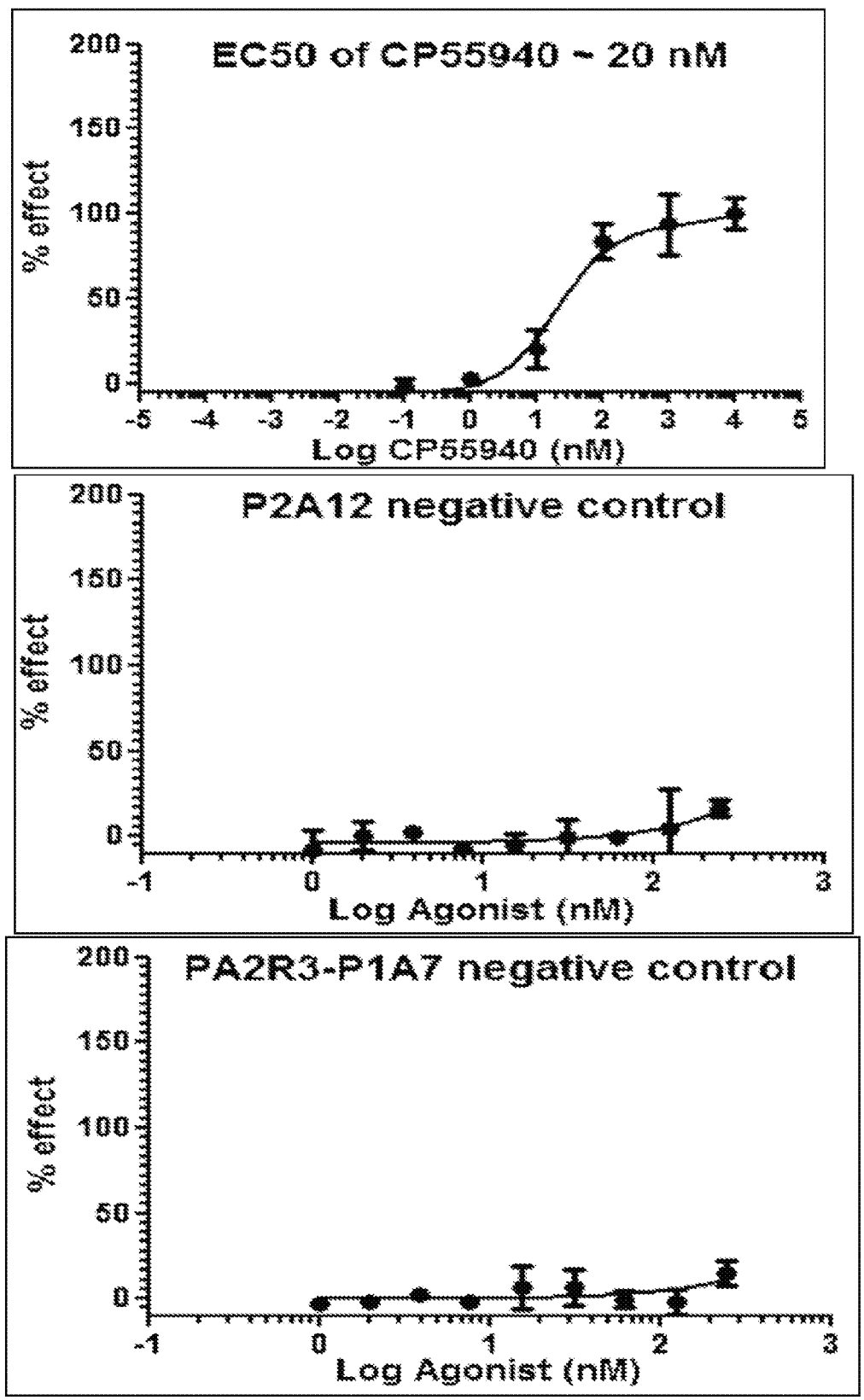

Results from the cAMP agonist screening identified four potential agonist IgGs including PA2LR3-P2D3, PA2LR3-P4B1, PA2LR3-P6G7 and PA2LR3-P6B12. In particular, PA2LR3-P2D3, PA2LR3-P4B1, and PA2LR3-P6G7 exhibited EC50>300 nM, as shown in FIGS. 6A and 6B. Further, PA2LR3-P6B12 is a potential allosteric modulator, with an EC50 of about 1000 nM in the presence of CP55940, as shown in FIG. 6C. Positive and negative controls are shown in FIGS. 6B and 6D.

Figure 7:
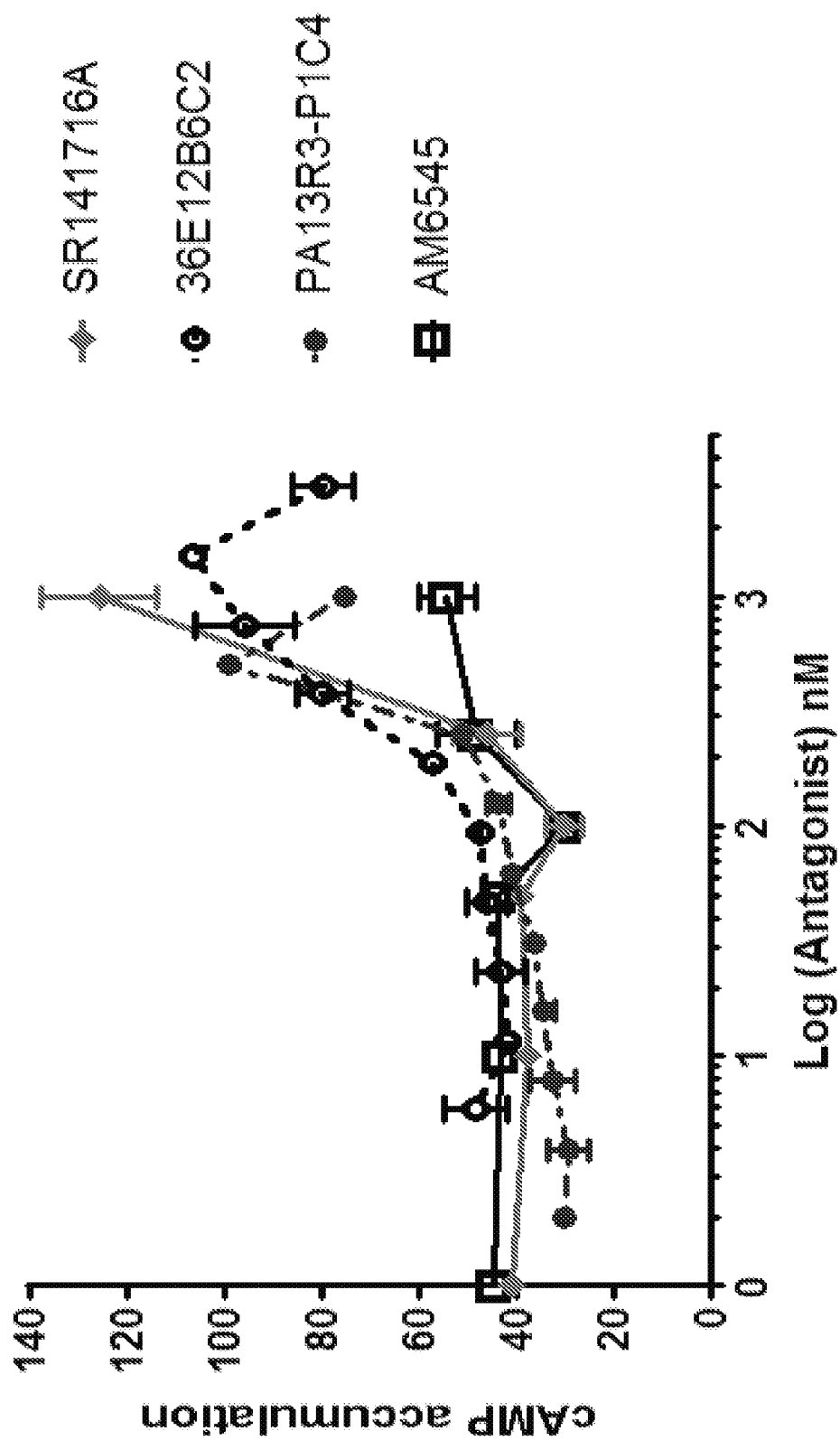
FIG. 7 shows the results of a cAMP assay conducted to assess the inverse agonist or neutral antagonist activity of PA13R3-P1C4 and 36E12B6C2. AM6545 and SR141716A were used as positive controls for neutral antagonist and inverse agonist respectively.

A cAMP assay was also performed to further characterize PA13R3-P1C4 and 36E12B6C2. The cAMP functional assay (Cisbio) was performed on white 384-well low volume plates (Greiner). 8000 cells/well of stably expressing CB1 TRex-CHO cells were seeded to the plate followed by incubating antagonists, including AM6545, SR141716A, PA12R3-P1C4 and 36E12B6C2, at concentrations ranging from 3 µM to 0 µM for 10 minutes at room temperature. After 10 minutes incubation, 5 µM of forskolin (Sigma Aldrich) were added to the cells stimulation mixture and incubated for 30 min at room temperature. To quantify for the cAMP production, 5 µL of cAMP-d2 and 5 µL of anti-cAMP cryptate were added to the cells stimulation and incubated for an hour. FRET signal was detected with EnVision multilabel plate reader (Perkin Elmer) when anti-cAMP cryptate excitation at 620 nm and emission at 665 nm. Data analysis was performed using GraphPad Prism software. The results of the study are shown in FIG. 7. Previously, AM6545 and SR141716A have been characterized as neutral antagonist and inverse agonist, respectively. The results from the cAMP functional assays indicated that PA12R3-P1C4 and 36E12B6C2 have similar inhibition patterns as SR141716A, suggesting that PA12R3-P1C4 and 36E12B6C2 are inverse agonists.

Example 12. iCAPS ELISA Binding Assay

Figure 8A:
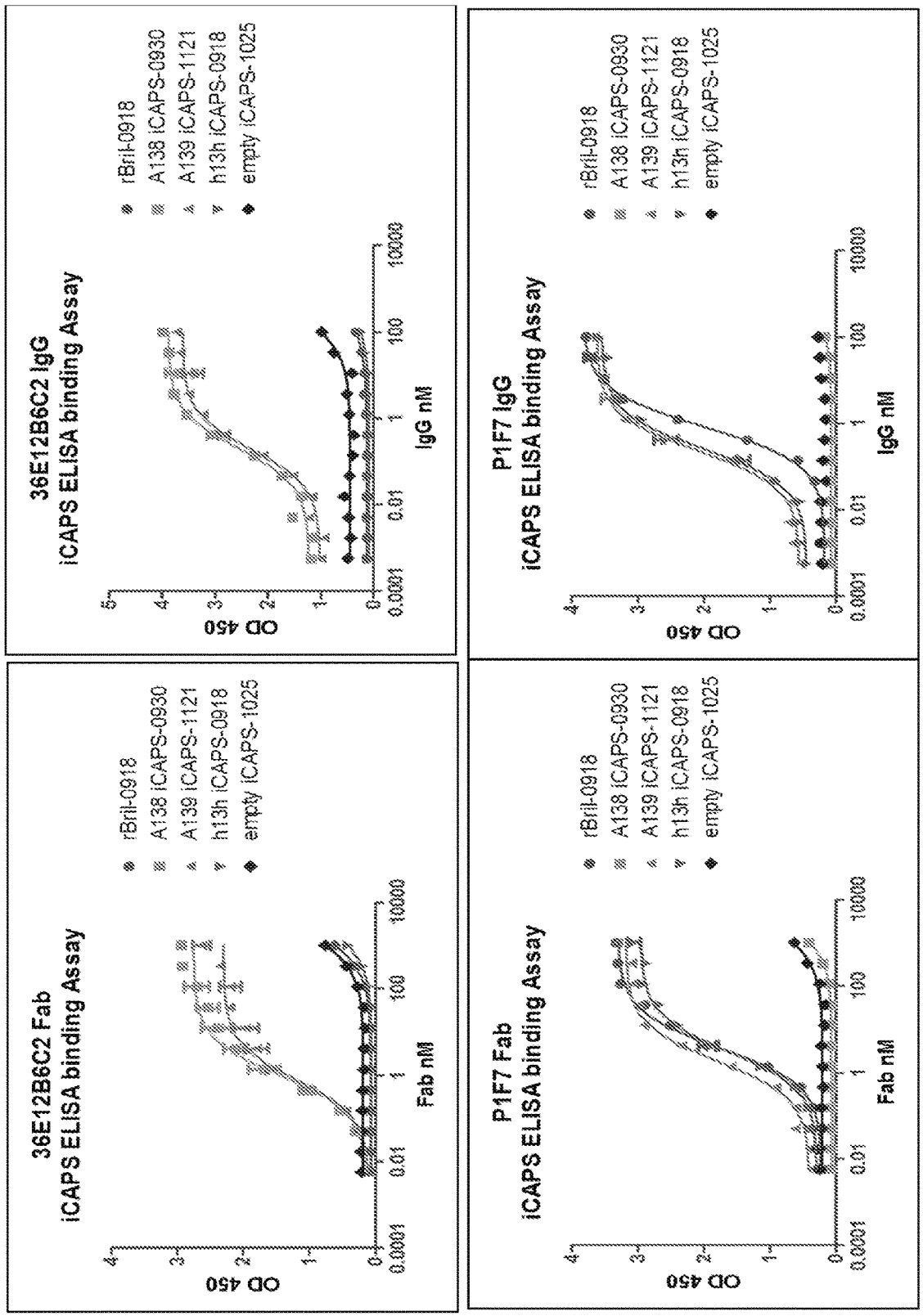
FIG. 8A shows an iCAPS ELISA binding assay assessing 36E12B6C2 Fab (top left panel) or IgG (top right panel), or P1F7 Fab (bottom left panel) or Fab (bottom right panel) to rBril-0918, empty iCAPS, iCAPS that do not express CB1 receptor (h13h iCAPS), or iCAPS that express human CB1 receptor (A138 iCAPS and A139 iCAPS).
Figure 8B:
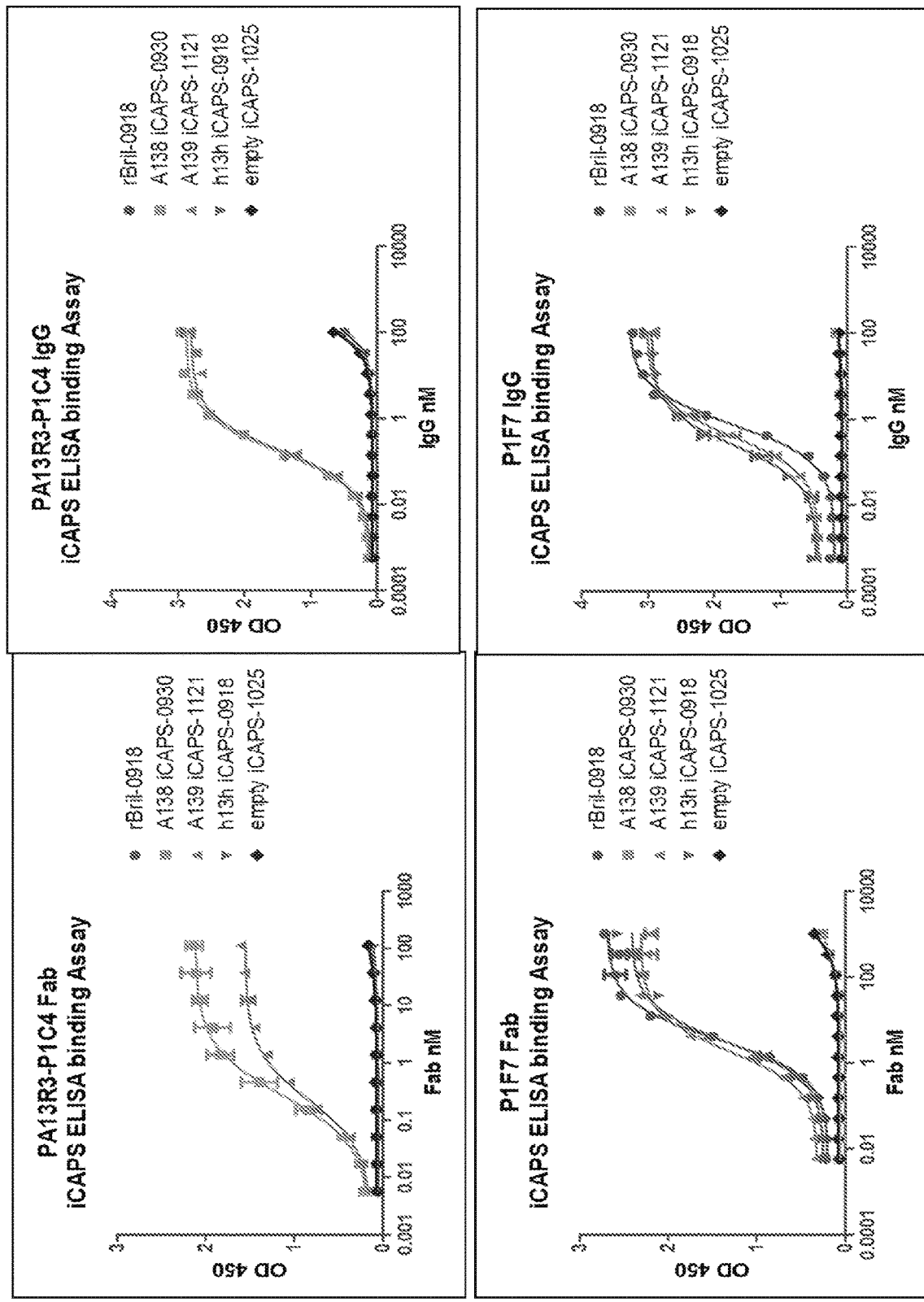
FIG. 8B shows an iCAPS ELISA binding assay assessing PA13R3-P1C4 Fab (top left panel) or IgG (top right panel), or P1F7 Fab (bottom left panel) or Fab (bottom right panel) to rBril-0918, empty iCAPS, iCAPS that do not express CB1 receptor (h13h iCAPS), or iCAPS that express human CB1 receptor (A138 iCAPS and A139 iCAPS).

An ELISA binding assay was carried out to assess binding of CB1 receptor IgG or Fab antibodies to iCAPS expressing CB1 (A138 containing ICL3 native sequence replacement with protein 1 sequence and A139 containing ICL3 native sequence replacement with BRIL), iCAPS expressing 5HT2B (h13h), empty iCAPS, or rBril-0918. IgG and Fab molecules tested were 36E12B6C2 IgG, 36E12B6C2 Fab, PA13R3-P1C4 IgG, and PA13R3-P1C4 Fab, compared to negative control BRIL binder P1F7 IgG and P1F7 Fab. For IgG antibodies, the secondary antibody used to detect binding was anti-mouse IgG-HRP; for Fabs, the secondary antibody used to detect binding was anti-human IgG-HRP. The results of the study are shown in FIGS. 8A and 8B and below in Table 8. For both A138 iCAPS and A139 iCAPS binding, 36E12B6C2 Fab yielded higher EC50 values relative to 36E12B6C2 IgG. In contrast, PA13R3-P1C4 IgG and Fab yielded approximately equivalent EC50 values for binding to both A139 and A138. None of the CB1 antibodies or Fabs exhibited binding to rBril-0918, empty iCAPs, or iCAPS expressing 5HT2B. The control mAb P1F7 recognizes BRIL, and hence shows binding to A139 containing BRIL fusion in ICL3, but not to A138 lacking BRIL.

TABLE 8

| EC50 values in 36E12B6C2 and PA13R3-P1C4 IgG and Fab ELISA | | |
|---|---|---|
| EC50 | A139 | A138 |
| 36E12B6C2 Fab | 0.8054 | 1.017 |
| 36E12B6C2 IgG | 0.19 | 0.2011 |
| PA13R3-P1C4 Fab | 0.27 | 0.23 |
| PA13R3-P1C4 IgG | 0.17 | 0.17 |

Example 13. CB1 Receptor Internalization Study

Figure 9A:
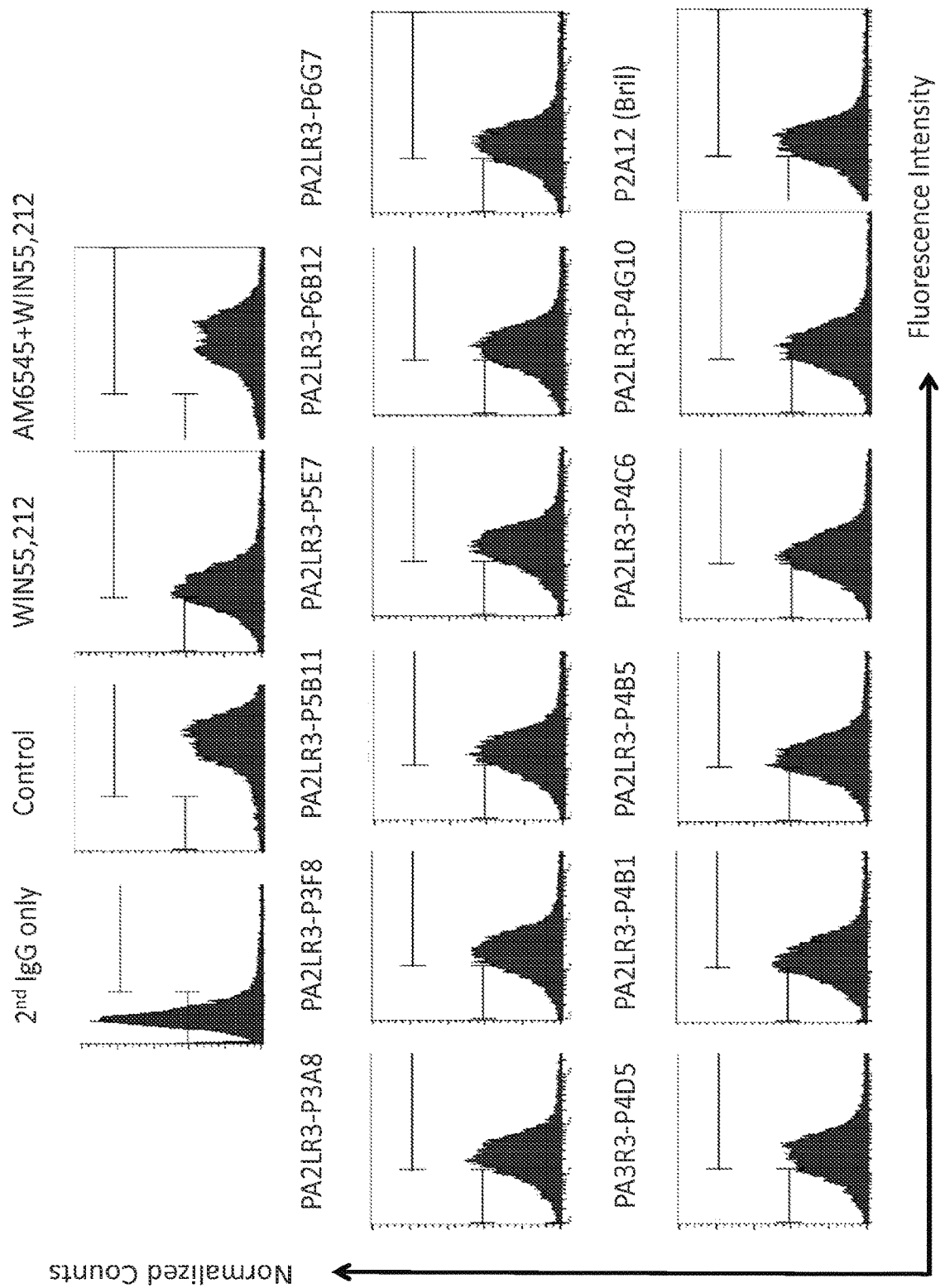
FIGS. 9A and 9B show CB1 receptor internalization following various treatments.

The impact of CB1 antibody on WIN55,212 (CB1 specific agonist) induced CB1 internalization was examined by flow cytometry. $5 \times 10^5$ cells/well stably expressing CB1 TRex-CHO cells were seeded in a 6-well plate. Tetracycline (1 µg/ml) was added to culture medium for 24 hours to induce CB1 expression. On the day of the experiment, cells were serum starved for 2 hours. Cells were then pre-incubated with CB1 antibody (300 nM), AM6545 (CB1 neutral antagonist) and negative control (BRIL binder) for half an hour. CB1 agonist (1 µM WIN55,212) was then added to the culture media for 1 hour to induce receptor internalization. Surface expression of CB1 was stained with anti-CB1 N-terminus mouse monoclonal antibody from R&D and the mean fluorescence intensity (MFI) was determined using flow cytometry. The results of the study are shown in FIG. 9A. Treatment with CB1 agonist WIN55,212 showed a reduction in MFI compared to control suggesting internalization of CB1 (FIG. 9A, top row of histograms). Pre-treatment with CB1 specific neutral antagonist AM6545 blocked WIN55,212 induced CB1 receptor internalization (FIG. 9A, top row of histograms). Pre-treatment of CB1 antibodies (300 nM) did not affect WIN55,212 induced CB1 receptor internalization (FIG. 9A, middle and bottom rows of histograms).

Figure 9B:
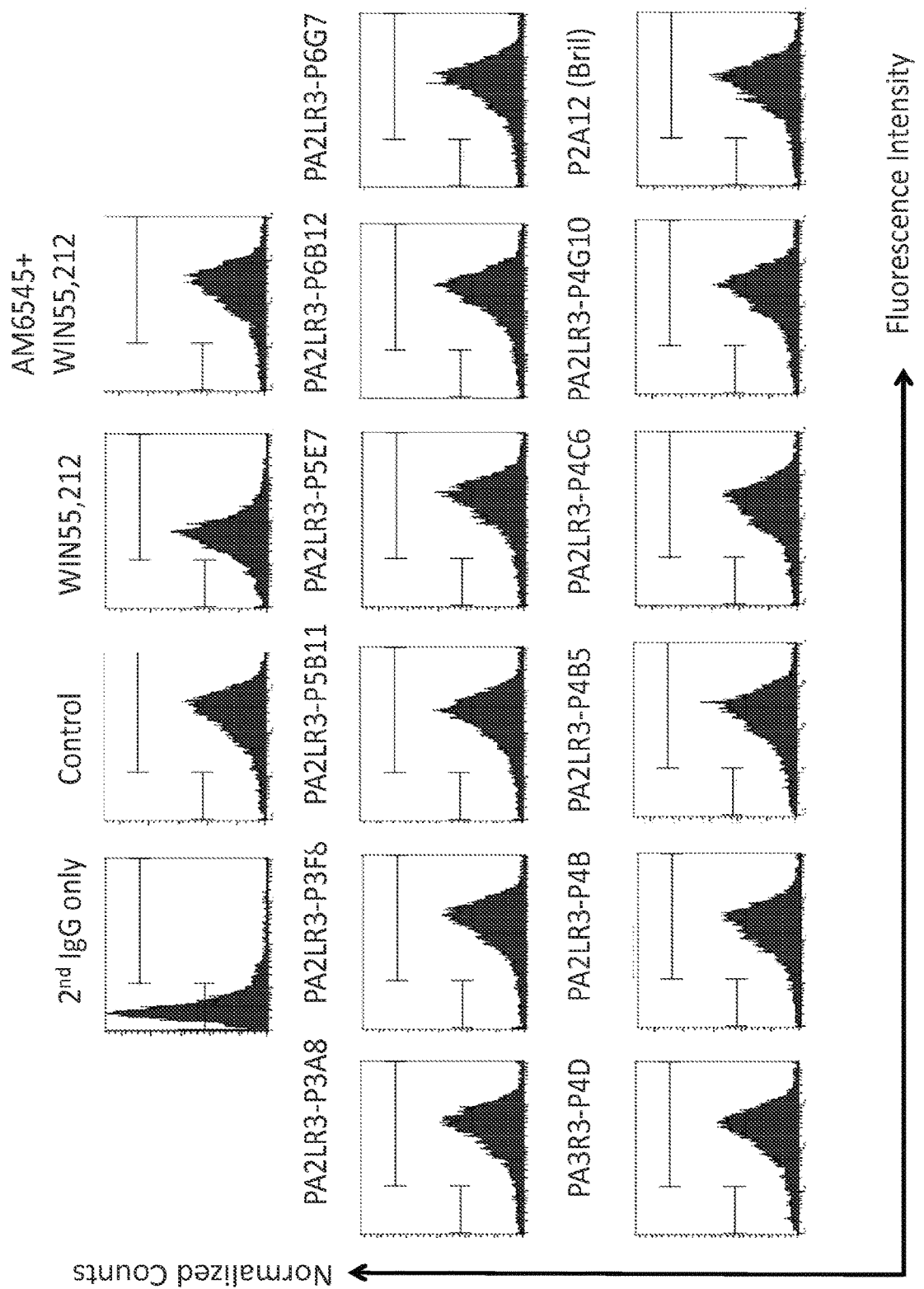

The impact of CB1 antibody on receptor internalization was also investigated. After 2 hours serum starvation, 300 nM CB1 antibodies, P2A12 negative control (BRIL binder) and CB1 agonist WIN55,212 were added to the culture media for 1 hour. Cells were harvested and stained with anti-CB1 N-terminus mouse monoclonal antibody (R&D). The results of the study are shown in FIG. 9B. Again, WIN55212 induced CB1 receptor internalization and blocked by pre-treatment with CB1 neutral antagonist AM6545 (FIG. 9B, top row of histograms). Surface expression of CB1 was not affected by CB1 antibodies suggesting CB1 antibodies did not induce receptor internalization (FIG. 9B, middle and bottom rows of histograms).

Example 14. Potency of Humanized CB1 Antibodies

Humanized P1C4 antibodies were generated and tested for potency, specificity, and affinity. To generate the humanized P1C4 antibodies, human frameworks were selected based on homology between P1C4 and human germline VH and VK genes. The selected frameworks had the highest homology with the PIC4 VH and VK regions and were selected based on computer modeling as being able to support the CDR structure predicted to be presented by PIC4. The following humanized antibodies were generated: (1) P1C4-H0—IgG; (2) P1C4-H2 (YE)—IgG (comprising G27Y and T28E mutations in the heavy chain variable region); and (3) P1C4-H4 (YENG)—IgG (comprising G27Y, T28E, A60N, an Q61G mutations in the heavy chain variable region)

A cAMP assay was performed in order to determine the potency of chimeric PA13R3-P1C4 and humanized PA13R3-P1C4 antibodies. The cAMP functional assay (Cisbio) was performed on white 384-well low volume plates (Greiner). 8,000 cells/well of stably expressing native human CB1 TRex-CHO cells were seeded to the plate, followed by incubating Rimonabant (SR141716A), PA12R3-P1C4 chimeric, PA12R3-P1C4 H0 (no back mutation), PA12R3-P1C4 H2 (YE), PA12R3-P1C4 H4 (YENG) and P2A12 (negative control), at concentrations ranging from 1 μM to 0 μM for 10 minutes at room temperature. After 10 minutes, 5 μM of forskolin (Sigma Aldrich) was added to the stimulation mixture and incubated for 30 min at room temperature. To quantify cAMP production, 5 μL of cAMP-d2 and 5 μL of anti-cAMP cryptate were added and incubated for one hour. A FRET signal was detected with EnVision multilabel plate reader (Perkin Elmer) with anti-cAMP cryptate excitation at 620 nm and emission at 665 nm. Data analysis was performed using GraphPad Prism software.

Figure 10:
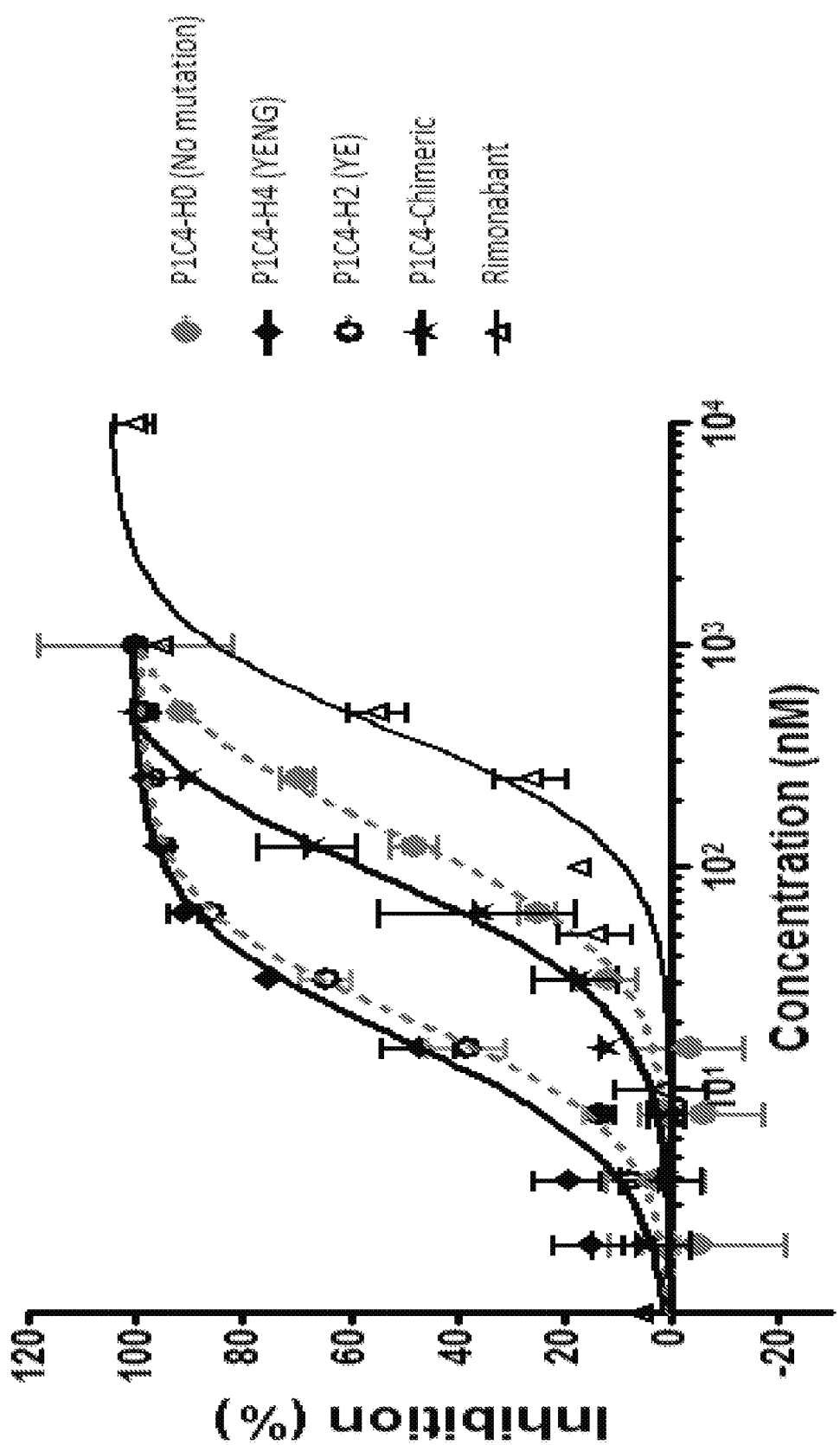
FIG. 10 shows the results of the cAMP functional antagonist assay for humanized versus chimeric P1C4 antibodies. Humanized antibody P1C4-H0 exhibited antagonistic activity that was similar to the chimeric P1C4 antibody. Humanized antibodies P1C4-H4 and PIC4-H2 exhibited antagonistic activity that was more potent relative to the chimeric P1C4 antibody or to positive control small molecule CB1 receptor inhibitor rimonabant.

The results of the study are provided in FIG. 10 and below in Table 9. The cAMP functional assay indicated that humanized P1C4-H2 and P1C4-H4 have an IC50 of 21 nM and 17 nM, respectively. Thus, of the antibodies tested, the humanized antibodies H1C4-H2 and PIC4-H4 exhibited potency even greater than the corresponding chimeric antibody, as measured by inhibition of cAMP.

TABLE 9

IC50 for chimeric and humanized CB1 antibodies

| | PA13R3-P1C4 chimeric | P1C4-H0 No mutation | P1C4-H2 (YE) | P1C4-H4 (YENG) | Rimonabant |
|---|---|---|---|---|---|
| IC50 (nM) | 93 | 146 | 21 | 17 | 415 |

The binding affinity, cross-reactivity and specificity of humanized P1C4 antibodies were determined by flow cytometry with TRex CHO parental cells, TRex CHO A56 overexpressed CB1 cells (T210A/fusion partner), native human CB1 TRex CHO A156 cells, Trex parental (no CB1) cells, mouse CB1 cells, and human CB2 stable cells. 100 μl of $1 \times 10^6$ cells/ml of cells were incubated with PA13R3-P1C4 chimeric, humanized P1C4-H0 (no mutation), P1C4-H2 (YE), P1C4-H4 (YENG) or P2A12 (control) IgGs in 3-fold serial dilutions starting from 300 nM to 0.5 nM for 30 minutes on ice. After being washed with 200 μl of FACS buffer twice, cells were incubated with PE conjugated anti-human secondary antibody (Southern Biotech) for 30 minutes on ice. Cells were washed with 200 μl of FACS buffer twice and transferred to BD Falcon 5 ml tube and analyzed by flow cytometry (BD FACScalibur).

TABLE 10

Binding affinity and cross-reactivity of humanized P1C4 antibodies

| Kd (nM) | TRexCHO A56 CB1 T210A/fusion partner | TRexCHO A156 Native human CB1 | TRexCHO parental | TRexCHO Mouse CB1 | TRexCHO Human CB2 |
|---|---|---|---|---|---|
| PA13R3-P1C4 chimeric | 10.5 | 25 | No binding | No binding | No binding |
| P1C4-H0 No mutation | 4.5 | 25 | No binding | No binding | No binding |
| P1C4-H2 (YE) | 4.2 | 9.4 | No binding | No binding | No binding |
| P1C4-H4 (YENG) | 4.0 | 9.6 | No binding | No binding | No binding |
| P2A12 (control) | No binding | No binding | No binding | No binding | No binding |

Figure 11A:
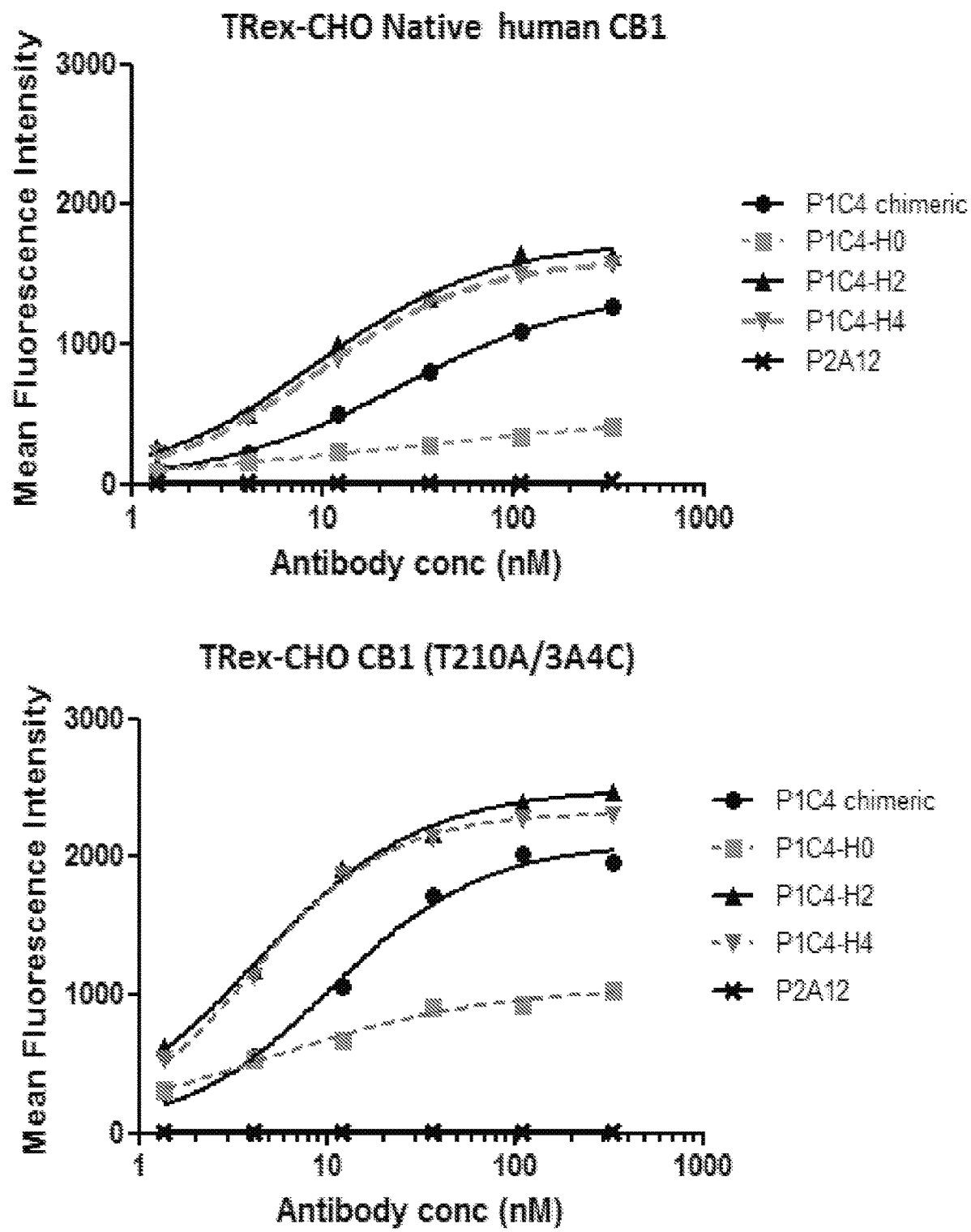
FIG. 11 shows the binding affinity, cross-reactivity, and specificity of humanized P1 C4 antibodies as measured by flow cytometry. Humanized P1C4 antibodies P1C4-H2 and PIC4-H4 exhibited superior binding affinity to both native human CB1 cells (FIG. 11A, top panel) and to overexpressed CB1 cells (FIG. 11A, bottom panel) relative to the P1C4 chimeric antibody. None of the chimeric or humanized antibodies bound to mouse cells expression mouse CB1, TRex-CHO parental cells, or TRex-CHO cells expressing human CB2 (FIG. 11B).
Figure 11B:
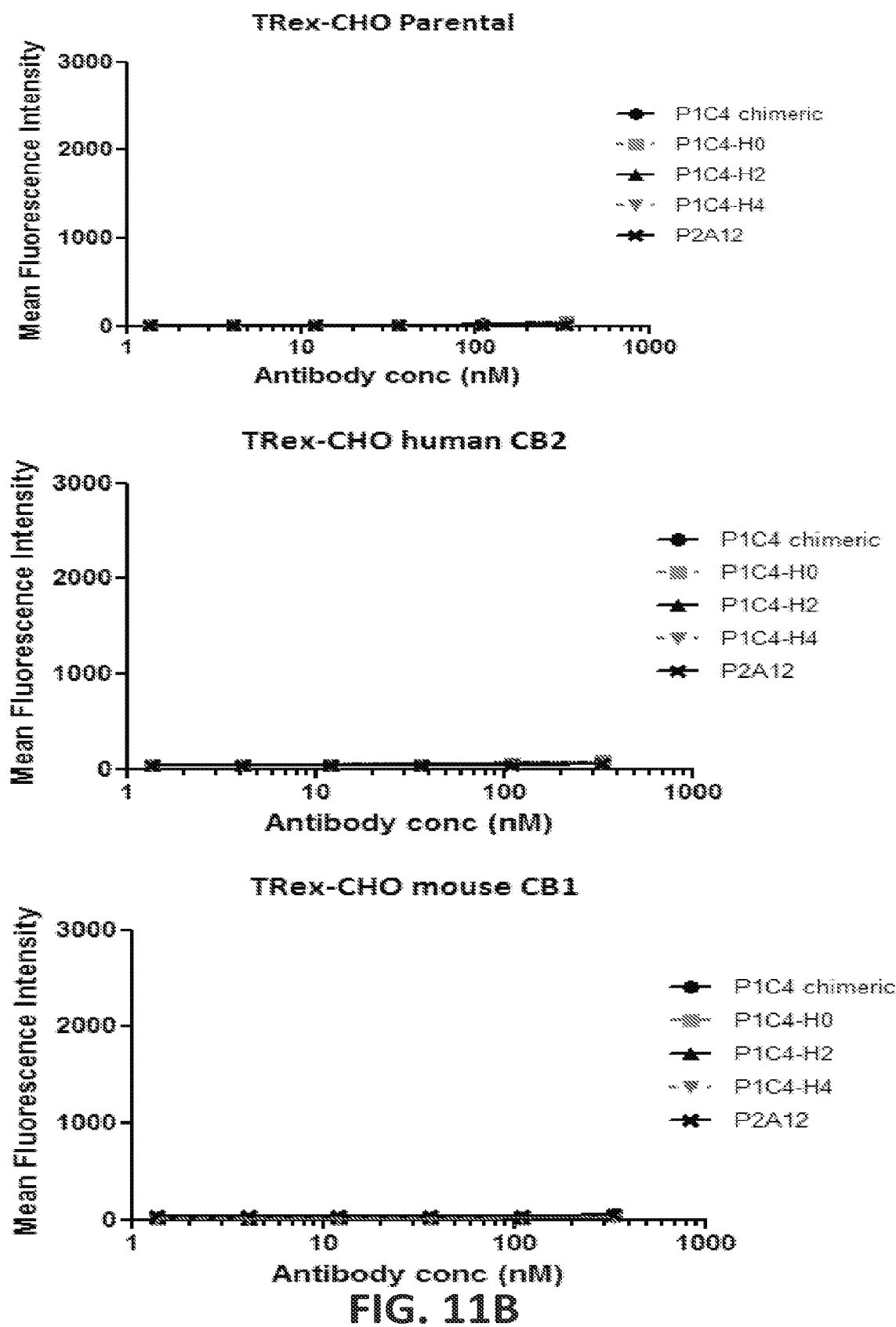

The results of the study are shown in FIG. 11 and above in Table 10. The humanized CB1 antibodies bound to A56 cells and A156 cells. Humanized antibodies P1C4-H2 and PIC4-H4 both bound to TRex CHO A56 overexpressed CB1 cells as well as to native human CB1 A156 cells with higher affinity relative to the chimeric P1C4 antibody (FIG. 11A). In addition, none of the antibodies tested exhibited cross-reactivity with mouse CB1 or with human CB2 (FIG. 11B).

Example 15. Reduced Effector Function CB1 Antibodies

CB1 antagonist antibodies designed to exhibit reduced effector function are constructed and tested. CB1 antagonist antibodies having one or more of the following Fc modifications are generated: (1) IgG4 constant region with a serine to proline mutation at position 228 (S228P); (2) IgG2 constant region with an alanine to serine mutation at position 330 (A330S) and a proline to serine mutation at position 331 (P331S); and (3) IgG2/IgG4 hybrid constant region.

The resulting humanized CB1 antibodies having 0, 2, or 4 backmutations in the framework regions are provided as SEQ ID NOs: 343-351. The antibodies are tested for the extent of binding to Fcy receptors and complement C1q by ELISA. The resulting CB1 antibodies are also tested for their abilities to activate primary human immune cells in vitro. Specifically, the CB1 antibodies having one or more Fc modification are tested for activation of immune cells, for example, by assessing their crosslinking capacity or the ability of the antibodies to induce expression of activation markers. The results of the study show that the CB1 antagonist antibodies have reduced FcγR binding and/or reduced C1q binding and/or reduced immune cell activation relative to the corresponding CB1 antagonist antibody that does not contain the constant region modification.

Example 16. Biodistribution Study

Figure 12:
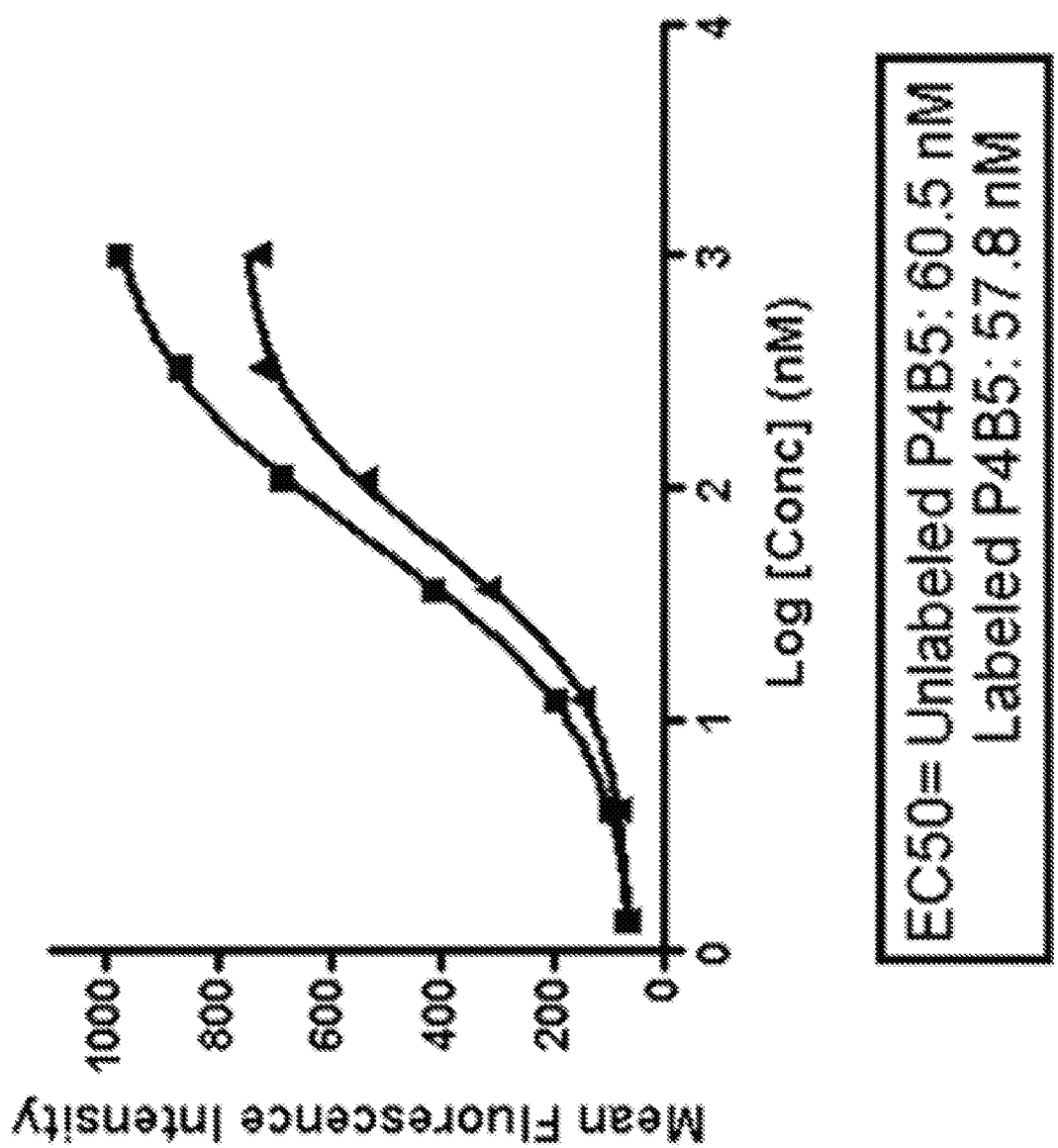
FIG. 12 shows the affinity of unlabeled P4B5 antibody versus Vivotag 680 XL-labeled P4B5 antibody to CB1 on cells.

A study was conducted to determine the biodistribution of CB1 antibody P4B5 in vivo in mice. Antibody P4B5 was labeled with Vivotag 680 XL (Perkin Elmer), and hairless mice (n=4 per group) were injected IV with 5 mg/kg or 25 mg/kg of labeled antibody. Whole body imaging was conducted using fluorescence mediated tomography (FMT) at the following timepoints: 0 hours (0 h), 1 h, 5 h, 24 h, 48 h, 72 h, 96 h, and 144 h to measure fluorescence in various tissues. Labeled P4B5 exhibited similar binding affinity to CB1 cells relative to unlabeled P4B5, as shown in FIG. 12. The EC50 for unlabeled P4B5 was 60.5 nM, and the EC50 for P4B5 antibody labeled with Vivotag 680 XL was 57.8 nM.

Figure 13B:
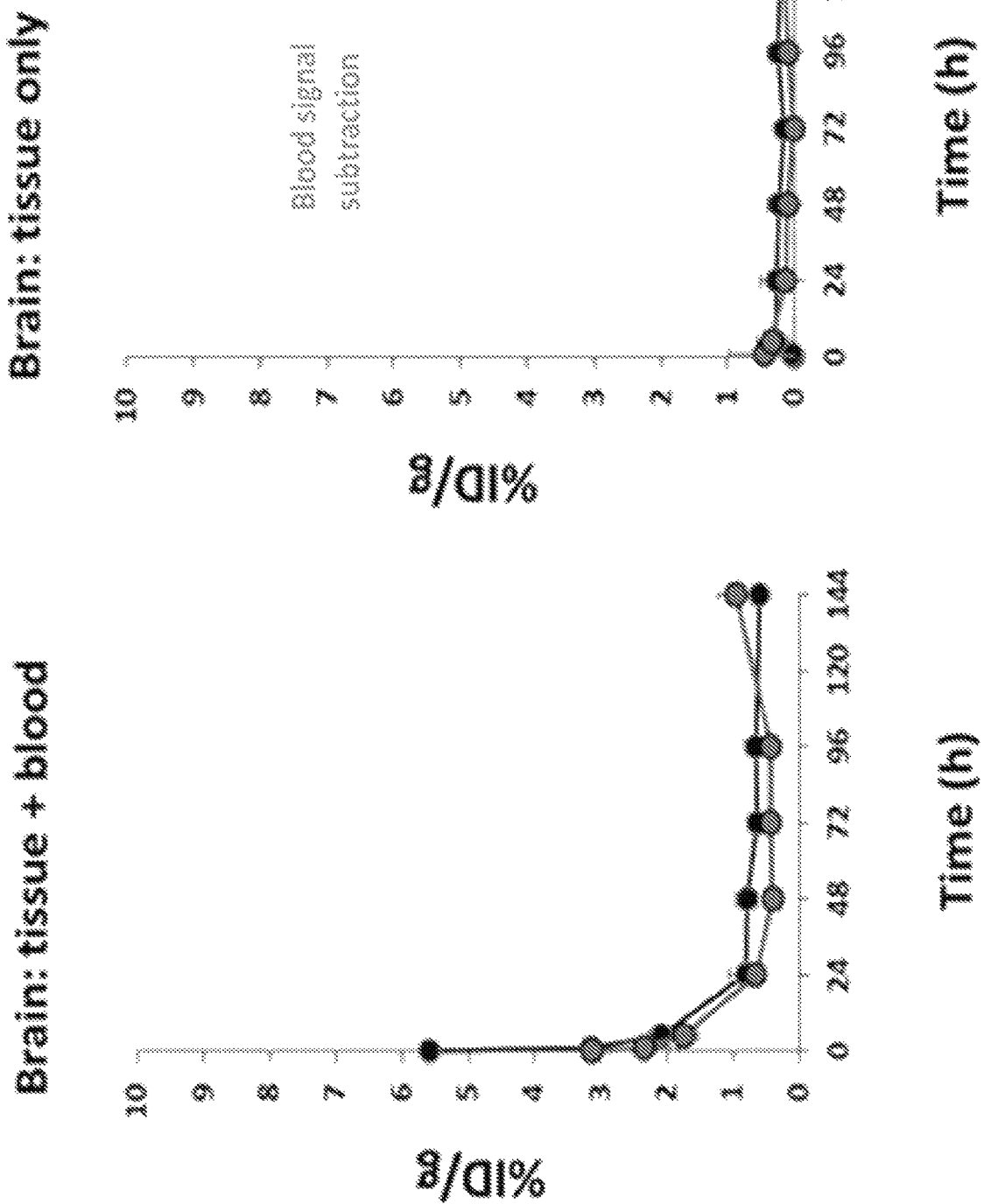
FIG. 13B shows the detection of labeled antibody in the brain including both tissue and blood (left panel) versus detection of labeled antibody in the brain with the blood signal subtracted (i.e., brain tissue only; right panel).

The results of the study are shown in FIGS. 13A and 13B. Labeled antibody was detected throughout the timecourse, as shown in FIGS. 13A.1 and A.2, which provides the data from a representative mouse that received the higher antibody dose (25 mg/kg). However, when the background signal from blood was subtracted, anti-CB1 antibody was not detectable in the brain (FIG. 13B), indicating that the antibody did not penetrate the blood-brain barrier after IV injection.

Example 17. Expression and Analysis of IgG for PA13R3-P1C4 Humanized Variants

Among the different human IgG subclasses, the Fc regions of IgG2 and IgG4 subclasses bind poorly to effector molecules, such as activating FcγRs or complement 1q (C1q), resulting in lower effector function activity. In order to minimize the activation of immune effector function humanized lead series antibodies P1C4-H2 and P1C4-H4 were cloned into 3 human Fc framework variants, IgG2, IgG4, and a hybrid between IgG2 and IgG4, for further characterization.

The variable region of the heavy chain of humanized P1C4-H2 (SEQ ID NO: 340), the variable region of the heavy chain of humanized P1C4-H4 (SEQ ID NO: 341), and the light chain of humanized P1C4 (SEQ ID NO: 338) are shown below in Table 11. Bold residues are back mutations and the underlined residues denote CDR regions. To make the Fc variants in different IgG families, three heavy chain constant region sequences were used. The sequence of the IgG2 heavy chain constant region (SEQ ID NO: 433), IgG4 heavy chain constant region (SEQ ID NO: 434), hybrid IgG2/4 heavy chain constant region (SEQ ID NO: 435) are shown below in Table 11.

TABLE 11

Design of Fc variants

| Antibody/Fragment Name or Sequence Description | Sequence | SEQ ID NO: |
|---|---|---|
| Humanized P1C4-H2 heavy chain variable region | QVQLVQSGAEVKKPGSSVKVSCKASGYEF<u>SYYWMN</u>WVRQAPGQGL EWMG<u>QIYPGDGETKYAQKFQG</u>RVTITADKSTSTAYMELSSLRSEDTA VYYCAR<u>SHGNYLPY</u>WGQGTLVTVSS | 340 |
| Humanized P1C4-H4 heavy chain variable region | QVQLVQSGAEVKKPGSSVKVSCKASGYEF<u>SYYWMN</u>WVRQAPGQGL EWMG<u>QIYPGDGETKYNGKFQG</u>RVTITADKSTSTAYMELSSLRSEDTA VYYCAR<u>SHGNYLPY</u>WGQGTLVTVSS | 341 |
| Humanized P1C4 full light chain | EIVLTQSPATLSLSPGERATLSCRASQSVS<u>SSYLH</u>WYQQKPGQAPRLLI <u>YSTSNLAS</u>GIPARFSGSGSGTDFTLTISRLEPEDFAVYYC<u>HQYHRSPPT</u> FGQGTKVEIKRTVAAPSVFIFPPSDEQLKSGTASVVCLLNNFYPREAK VQWKVDNALQSGNSQESVTEQDSKDSTYSLSSTLTLSKADYEKHKV YACEVTHQGLSSPVTKSFNRGEC | 338 |
| IgG2 heavy chain constant region | ASTKGPSVFPLAPCSRSTSESTAALGCLVKDYFPEPVTVSWNSGALTS GVHTFPAVLQSSGLYSLSSVVTVPSSNFGTQTYTCNVDHKPSNTKVD KTVERKCCVECPPCPAPPVAGPSVFLFPPKPKDTLMISRTPEVTCVVV DVSHEDPEVQFNWYVDGVEVHNAKTKPREEQFNSTFRVVSVLTVVH QDWLNGKEYKCKVSNKGLPSSIEKTISKTKGQPREPQVYTLPPSREEM TKNQVSLTCLVKGFYPSDIAVEWESNGQPENNYKTTPPMLDSDGSFF LYSKLTVDKSRWQQGNVFSCSVMHEALHNHYTQKSLSLSPGK | 433 |
| IgG4 heavy chain constant region | ASTKGPSVFPLAPCSRSTSESTAALGCLVKDYFPEPVTVSWNSGALTS GVHTFPAVLQSSGLYSLSSVVTVPSSSLGTKTYTCNVDHKPSNTKVD KRVESKYGPPCPPCPAPEFLGGPSVFLFPPKPKDTLMISRTPEVTCVVV DVSQEDPEVQFNWYVDGVEVHNAKTKPREEQFNSTYRVVSVLTVLH | 434 |

TABLE 11-continued

Design of Fc variants

| Antibody/Fragment Name or Sequence Description | Sequence | SEQ ID NO: |
|---|---|---|
| | QDWLNGKEYKCKVSNKGLPSSIEKTISKAKGQPREPQVYTLPPSQEE<br>MTKNQVSLTCLVKGFYPSDIAVEWESNGQPENNYKTTPPVLDSDGSF<br>FLYSRLTVDKSRWQEGNVFSCSVMHEALHNHYTQKSLSLSLGK | |
| Hybrid IgG2/4 heavy chain constant region | ASTKGPSVFPLAPCSRSTSESTAALGCLVKDYFPEPVTVSWNSGALTS<br>GVHTFPAVLQSSGLYSLSSVVTVPSSNFGTQTYTCNVDHKPSNTKVD<br>KTVERKCCVECPPCPAPEFLGGPSVFLFPPKPKDTLMISRTPEVTCVVV<br>DVSQEDPEVQFNWYVDGVEVHNAKTKPREEQFNSTYRVVSVLTVLH<br>QDWLNGKEYKCKVSNKGLPSSIEKTISKAKGQPREPQVYTLPPSQEE<br>MTKNQVSLTCLVKGFYPSDIAVEWESNGQPENNYKTTPPVLDSDGSF<br>FLYSRLTVDKSRWQEGNVFSCSVMHEALHNHYTQKSLSLSLGK | 435 |
| P1C4-H2-IgG2 | QVQLVQSGAEVKKPGSSVKVSCKASGYEFSYYWMNWVRQAPGQGL<br>EWMG<u>QIYPGDGETKY</u>AQKFQGRVTITADKSTSTAYMELSSLRSEDTA<br>VYYCAR<u>SHGNYLPY</u>WGQGTLVTVSSASTKGPSVFPLAPCSRSTSEST<br>AALGCLVKDYFPEPVTVSWNSGALTSGVHTFPAVLQSSGLYSLSSVV<br>TVPSSNFGTQTYTCNVDHKPSNTKVDKTVERKCCVECPPCPAPPVAG<br>PSVFLFPPKPKDTLMISRTPEVTCVVVDVSHEDPEVQFNWYVDGVEV<br>HNAKTKPREEQFNSTFRVVSVLTVVHQDWLNGKEYKCKVSNKGLPS<br>SIEKTISKTKGQPREPQVYTLPPSREEMTKNQVSLTCLVKGFYPSDIAV<br>EWESNGQPENNYKTTPPMLDSDGSFFLYSKLTVDKSRWQQGNVFSCS<br>VMHEALHNHYTQKSLSLSPGK | 436 |
| P1C4-H2-IgG4 | QVQLVQSGAEVKKPGSSVKVSCKASGYEFSYYWMNWVRQAPGQGL<br>EWMG<u>QIYPGDGETKY</u>AQKFQGRVTITADKSTSTAYMELSSLRSEDTA<br>VYYCAR<u>SHGNYLPY</u>WGQGTLVTVSSASTKGPSVFPLAPCSRSTSEST<br>AALGCLVKDYFPEPVTVSWNSGALTSGVHTFPAVLQSSGLYSLSSVV<br>TVPSSSLGTKTYTCNVDHKPSNTKVDKRVESKYGPPCPPCPAPEFLGG<br>PSVFLFPPKPKDTLMISRTPEVTCVVVDVSQEDPEVQFNWYVDGVEV<br>HNAKTKPREEQFNSTYRVVSVLTVLHQDWLNGKEYKCKVSNKGLPS<br>SIEKTISKAKGQPREPQVYTLPPSQEEMTKNQVSLTCLVKGFYPSDIAV<br>EWESNGQPENNYKTTPPVLDSDGSFFLYSRLTVDKSRWQEGNVFSCS<br>VMHEALHNHYTQKSLSLSLGK | 437 |
| P1C4-H2-IgG2/4 | QVQLVQSGAEVKKPGSSVKVSCKASGYEFSYYWMNWVRQAPGQGL<br>EWMG<u>QIYPGDGETKY</u>AQKFQGRVTITADKSTSTAYMELSSLRSEDTA<br>VYYCAR<u>SHGNYLPY</u>WGQGTLVTVSSASTKGPSVFPLAPCSRSTSEST<br>AALGCLVKDYFPEPVTVSWNSGALTSGVHTFPAVLQSSGLYSLSSVV<br>TVPSSNFGTQTYTCNVDHKPSNTKVDKTVERKCCVECPPCPAPEFLG<br>GPSVFLFPPKPKDTLMISRTPEVTCVVVDVSQEDPEVQFNWYVDGVE<br>VHNAKTKPREEQFNSTYRVVSVLTVLHQDWLNGKEYKCKVSNKGLP<br>SSIEKTISKAKGQPREPQVYTLPPSQEEMTKNQVSLTCLVKGFYPSDIA<br>VEWESNGQPENNYKTTPPVLDSDGSFFLYSRLTVDKSRWQEGNVFSC<br>SVMHEALHNHYTQKSLSLSLGK | 438 |
| P1C4-H4-IgG2 | QVQLVQSGAEVKKPGSSVKVSCKASGYEFSYYWMNWVRQAPGQGL<br>EWMG<u>QIYPGDGETKY</u>NGKFQGRVTITADKSTSTAYMELSSLRSEDTA<br>VYYCAR<u>SHGNYLPY</u>WGQGTLVTVSSASTKGPSVFPLAPCSRSTSEST<br>AALGCLVKDYFPEPVTVSWNSGALTSGVHTFPAVLQSSGLYSLSSVV<br>TVPSSNFGTQTYTCNVDHKPSNTKVDKTVERKCCVECPPCPAPPVAG<br>PSVFLFPPKPKDTLMISRTPEVTCVVVDVSHEDPEVQFNWYVDGVEV<br>HNAKTKPREEQFNSTFRVVSVLTVVHQDWLNGKEYKCKVSNKGLPS<br>SIEKTISKTKGQPREPQVYTLPPSREEMTKNQVSLTCLVKGFYPSDIAV<br>EWESNGQPENNYKTTPPMLDSDGSFFLYSKLTVDKSRWQQGNVFSCS<br>VMHEALHNHYTQKSLSLSPGK | 439 |
| P1C4-H4-IgG4 | QVQLVQSGAEVKKPGSSVKVSCKASGYEFSYYWMNWVRQAPGQGL<br>EWMG<u>QIYPGDGETKY</u>NGKFQGRVTITADKSTSTAYMELSSLRSEDTA<br>VYYCAR<u>SHGNYLPY</u>WGQGTLVTVSSASTKGPSVFPLAPCSRSTSEST<br>AALGCLVKDYFPEPVTVSWNSGALTSGVHTFPAVLQSSGLYSLSSVV<br>TVPSSSLGTKTYTCNVDHKPSNTKVDKRVESKYGPPCPPCPAPEFLGG<br>PSVFLFPPKPKDTLMISRTPEVTCVVVDVSQEDPEVQFNWYVDGVEV<br>HNAKTKPREEQFNSTYRVVSVLTVLHQDWLNGKEYKCKVSNKGLPS<br>SIEKTISKAKGQPREPQVYTLPPSQEEMTKNQVSLTCLVKGFYPSDIAV<br>EWESNGQPENNYKTTPPVLDSDGSFFLYSRLTVDKSRWQEGNVFSCS<br>VMHEALHNHYTQKSLSLSLGK | 440 |

TABLE 11-continued

Design of Fc variants

| Antibody/Fragment Name or Sequence Description | Sequence | SEQ ID NO: |
|---|---|---|
| P1C4-H4-IgG2/4 | QVQLVQSGAEVKKPGSSVKVSCKASGYEFS<u>YYWMN</u>WVRQAPGQGL EWMG<u>QIYPGDGETKY</u>NGKFQGRVTITADKSTSTAYMELSSLRSEDTA VYYCAR<u>SHGNYLPY</u>WGQGTLVTVSSASTKGPSVFPLAPCSRSTSEST AALGCLVKDYFPEPVTVSWNSGALTSGVHTFPAVLQSSGLYSLSSVV TVPSSNFGTQTYTCNVDHKPSNTKVDKTVERKCCVECPPCPAPEFLG GPSVFLFPPKPKDTLMISRTPEVTCVVVDVSQEDPEVQFNWYVDGVE VHNAKTKPREEQFNSTYRVVSVLTVLHQDWLNGKEYKCKVSNKGLP SSIEKTISKAKGQPREPQVYTLPPSQEEMTKNQVSLTCLVKGFYPSDIA VEWESNGQPENNYKTTPPVLDSDGSFFLYSRLTVDKSRWQEGNVFSC SVMHEALHNHYTQKSLSLSLGK | 441 |
| P1C4-Lc humanized | EIVLTQSPATLSLSPGERATLSCRASQSVSSSYLHWYQQKPGQAPRLLI YSTSNLASGIPARFSGSGSGTDFTLTISRLEPEDFAVYYCHQYHRSPPT FGQGTKVEIKRTVAAPSVFIFPPSDEQLKSGTASVVCLLNNFYPREAK VQWKVDNALQSGNSQESVTEQDSKDSTYSLSSTLTLSKADYEKHKV YACEVTHQGLSSPVTKSFNRGEC | 442 |

The antibody variants were expressed and purified in 293FreeStyle, CHO-S, and CHO-K1 cells in different batches on different dates.

For 293 FreeStyle expression separate pTT5 plasmids encoding heavy and light chain sequences were co-transfected into FreeStyle HEK293F cells for expression of full IgG antibodies. Cells were cultured at 37° C. with 5% $CO_2$ in FreeStyle 293 Expression Medium. Twenty four hours prior to transfection, cells were diluted to a density of $8\times10^5$ cells/mL. To prepare the transfection solution, 80 μg DNA (40 μg light chain+40 μg heavy chain) and 240 μg polyethylenimine (PEI) were diluted into 8 mL Freestyle 293F medium, mixed thoroughly and filtered through a 0.2 μm syringe-top filter into a 50 mL conical tube, then incubated for 15 minutes at 22° C. Eight mL of transfection solution were slowly added to 80 mL 293F cell culture (diluted in FreeStyle 293 Expression Medium to a density of $1.1$-$1.3\times10^6$ cells/mL), which were then incubated at 37° C. with 5% $CO_2$ with rotation at 130 rpm for 4 days. Supernatants from transfected cell cultures were harvested by centrifugation at 4000 rpm for 45 minutes at 4° C., adjusted to pH 8.0 with 0.1 M NaOH and held on ice until protein purification.

For CHO-S expression separate pTT5 plasmids encoding heavy and light chain sequences were co-transfected into CHO-S cells for expression of full IgG antibodies. Cells were cultured in CD-CHO medium at 37° C. with 5% $CO_2$. Twenty four hours prior to transfection, cells were diluted to a density of $0.6$-$0.7\times10^6$ cells/mL in CD-CHO medium. On the day of transfection, cells were diluted to a density of $1.1$-$1.3\times10^6$ cells/mL in CD-CHO medium in 250 mL shake flasks. To each 250 mL shake flask, 80 mL of cells were added. Eighty μg of plasmid DNA (40 μg light chain+40 μg heavy chain) was diluted into a final volume of 4 mL CD-CHO medium and filtered through a 0.2 μm syringe-top filter into a 50 mL conical tube. In a separate 50 mL conical tube, 80 μL of FreeStyle Max reagent were diluted into a final volume of 4 mL CD-CHO medium. These 2 mixtures were incubated at 22° C. for 3 minutes before they were combined, mixed and incubated for an additional 15 minutes at 22° C. The 8 mL DNA/transfection reagent mixture was slowly added to the 80 mL cell culture in the 250 mL flask. This brought the final density of cells to $\sim1.0\times10^6$ cells/mL. The culture flask was then incubated on an orbital shaking platform at 37° C. with 5% $CO_2$ at a speed of 133 rpm for 6 days. The culture supernatants were then harvested by centrifugation (Allegra X-15R, Beckman) at 4000×g for 40 minutes at 4° C., adjusted to pH 8.0 with 0.1 M NaOH and held on ice until protein purification.

IgG purification from 293 FreeStyle and CHO-S was performed as follows: supernatants were loaded onto Protein A columns (0.4 mL bed volume) pre-equilibrated with PBS pH 7.4 and allowed to flow through by gravity. Columns were washed with 5 mL of PBS pH 7.4 and protein was eluted with 4 mL of 0.1 M Na Citrate-HCl pH 3.5. The eluent was neutralized with 200 μL 1.5 M Tris-HCl buffer pH 8.8, concentrated and buffer-exchanged with PBS pH 7.4 using an Amicon 30 kDa 4 mL concentrator (Millipore), according to the manufacturer's instructions, to a final volume of approximately 0.5-1 mL. Protein concentrations were determined by absorbance at $280_{nm}$ and the purity was determined by SDS-PAGE and SEC.

Protein expression and purification in CHO-K1 was done with proprietary methods at a contract research organization (CRO). Briefly, CHO-K1 cells were used for transfection. IgG was purified with MabSelect™ SuRe™ beads and the wash steps used Dulbecco's PBS (Lonza BE17-512Q). IgG was eluted with 0.1M Glycine pH 3.5

For protein QC, 3 μg of antibody was used for each test, SDS-PAGE and SEC analysis. The QC passage criteria were purity >90% in SDS PAGE and monomeric peak >90% in SEC. For purified IgG protein which passed the QC tests, protein was aliquoted into screw caps tubes at 100 μL/tube, with concentration of ~5 mg/mL. The aliquots were flash frozen in liquid nitrogen and stored at −80° C.

Figure 14A:
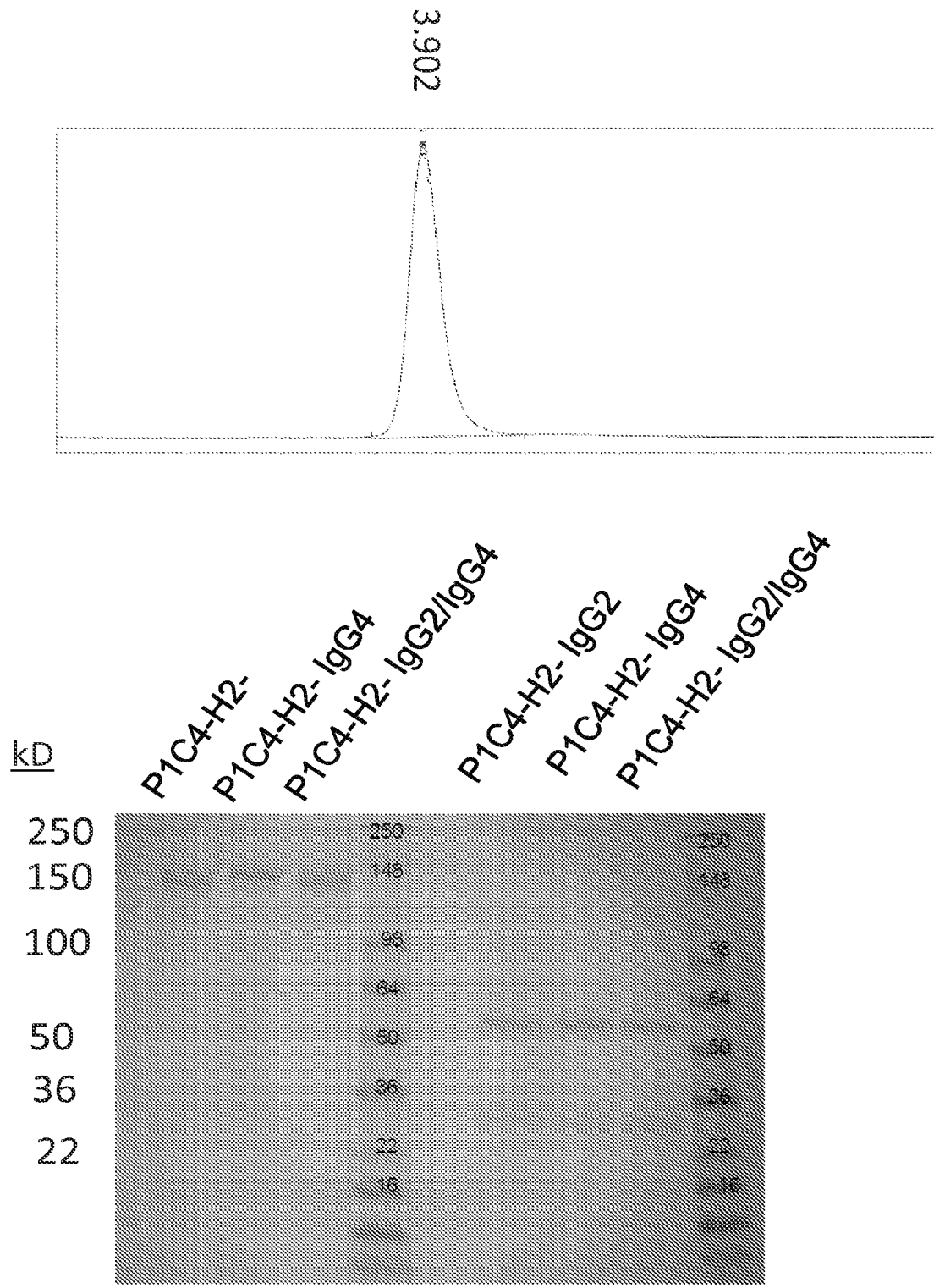
FIG. 14A shows the SEC profile (top) and SDS-PAGE (bottom) analyses for one of the 293 FreeStyle batches.
Figure 14B:
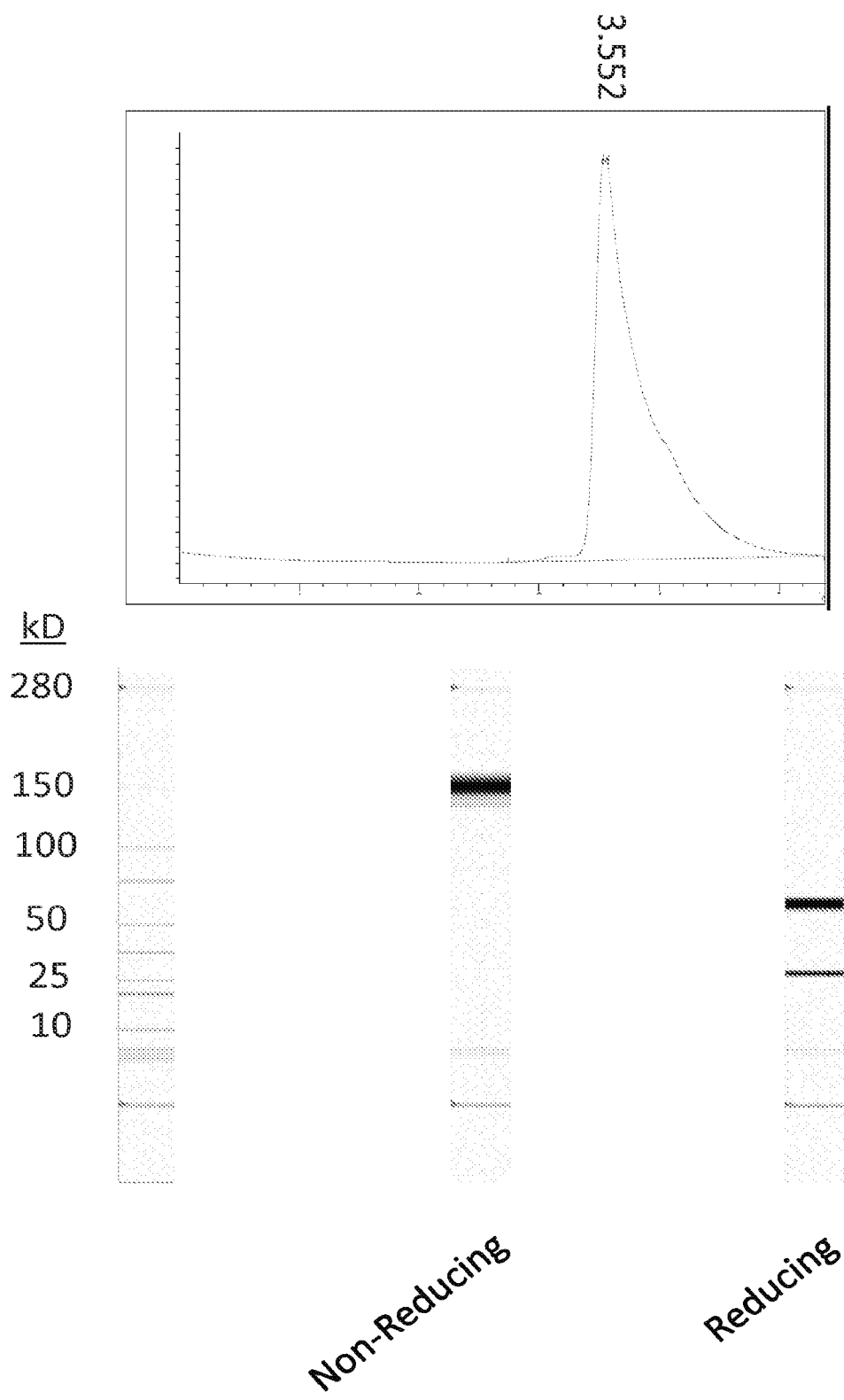
FIG. 14B shows the SEC profile (top) and SDS-PAGE (bottom) analyses for one of the CHO-K1 batches.

The protein yields in 293FreeStyle ranged from low mg/L to 53 mg/L. The yields in CHO-S cells were low at about 1 mg/L. The yields in CHO-K1 cells ranged from 198 mg/L to 350 mg/L. SDS-PAGE showed intact protein running at about 150 kDa under non-reducing conditions and 2 bands representing heavy chain and light chain with no visible degradation or aggregation. The SEC profiles and SDS-PAGE analyses for one of the 293 FreeStyle batches are shown in FIG. 14A and one of the CHO-K1 batches in FIG. 14B, as examples. Protein purification data for 293FreeStyle and CHO-S batches are summarized in Table 12.

TABLE 12

PA13R3-P1C4 mAb Protein Purification Summary

| Sample | Protein conc. (mg/mL) | Volume (uL) | Amount (ug) | Culture Vol. (mL) | Yield (mg/L) | Monomer by SEC (%) |
|---|---|---|---|---|---|---|
| P1C4-H2-IgG2 | 2.10 | 11500 | 24150.00 | 600.00 | 40.25 | >90 |
| P1C4-H2-IgG2 | 2.94 | 500 | 1470.00 | 160.00 | 9.19 | >90 |
| P1C4-H2-IgG4 | 2.24 | 14400 | 32256.00 | 600.00 | 53.76 | >90 |
| P1C4-H2-IgG4 | 2.22 | 500 | 1110.00 | 160.00 | 6.94 | >90 |
| P1C4-H2-IgG4 (CHO-S) | 0.28 | 250 | 69.00 | 80.00 | 0.86 | >90 |
| P1C4-H2-IgG2/4 | 2.18 | 12500 | 27250.00 | 600.00 | 45.42 | >90 |
| P1C4-H2-IgG2/4 | 1.01 | 600 | 606.00 | 160.00 | 3.79 | >90 |
| P1C4-H4-IgG2 | 2.23 | 7200 | 16056.00 | 600.00 | 26.76 | >90 |
| P1C4-H4-IgG2 | 3.43 | 750 | 2572.50 | 160.00 | 16.08 | >90 |
| P1C4-H4-IgG4 | 2.39 | 10700 | 25573.00 | 600.00 | 42.62 | >90 |
| P1C4-H4-IgG4 | 5.45 | 500 | 2725.00 | 160.00 | 17.03 | >90 |
| P1C4-H4-IgG4 (CHO-S) | 0.28 | 250 | 68.75 | 80.00 | 0.86 | >90 |
| P1C4-H4-IgG2/4 | 2.02 | 9700 | 19594.00 | 600.00 | 32.66 | >90 |
| P1C4-H4-IgG2/4 | 3.14 | 750 | 2355.00 | 160.00 | 14.72 | >90 |

Example 18. cAMP Functional Assays for PA13R3-P1C4 Humanized Variants

A commercially available kit (Cisbio) based on a competitive immunoassay format using cryptate-labeled anti-cAMP antibody and d2-labeled cAMP was used to characterize PA13R3-P1C4 humanized variant antibodies by measuring changes in intracellular cAMP levels in TRex-CHO cells stably expressing CB1. Cell numbers, forskolin concentration and CP55,940 concentration were optimized according to the manufacturer's instructions. The cAMP antagonist functional assay was performed in white 384-well low volume plates (Greiner). TRex-CHO cells expressing human CB1 were seeded at a density of eight thousand cells/well in serum free Ham's F12 media followed by incubating mAb or control compound at various concentrations at 22° C. for 10 minutes. Five μM forskolin (at EC20, Sigma Aldrich) and 9 nM CP55,940 (at EC80, Sigma Aldrich) were subsequently added to the cells and incubated for 30 minutes at 22° C. to enhance adenylyl cyclase activity and activate CB1 signaling, respectively. Five μL cAMP-d2 (1:39 dilution with conjugate and lysis buffer provided by Cisbio) and 5 μL anti-cAMP cryptate (1:9 dilution with conjugate and lysis buffer provided by Cisbio) were then added to the cells and incubated for 1 hour at 22° C. FRET signal was detected with Envision multilabel plate reader (Perkin Elmer) at anti-cAMP cryptate excitation at 620 nm and emission at 665 nm. Data analysis was performed using GraphPad Prism.

Figure 15:
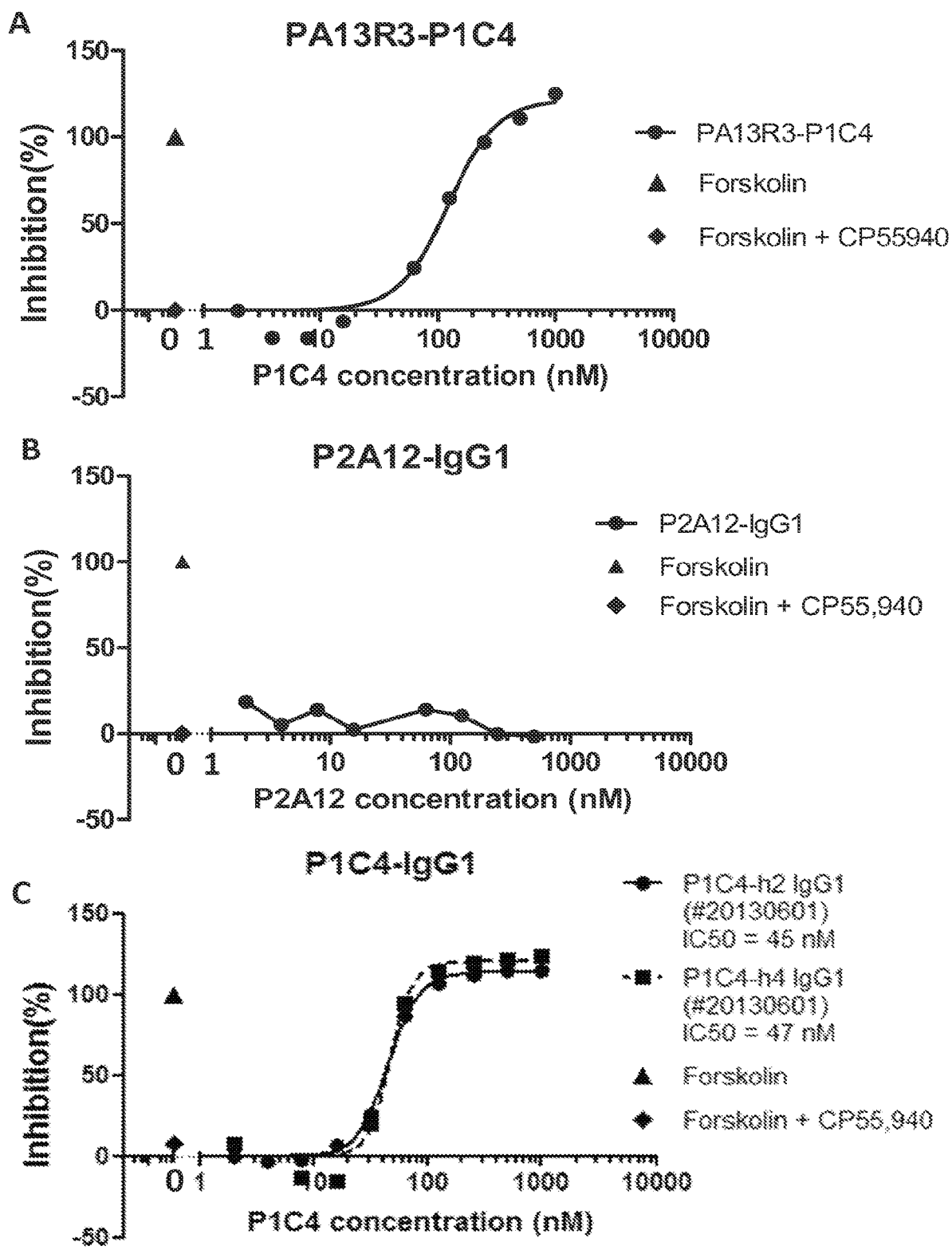
FIG. 15 shows cAMP functional assays for PA13R3-P1C4 humanized variants compared with parental chimeric PA13R3-P1C4 and P2A12 mAb, a non-GPCR targeting mAb negative control antibody of IgG1 isotype.
Figure 15:
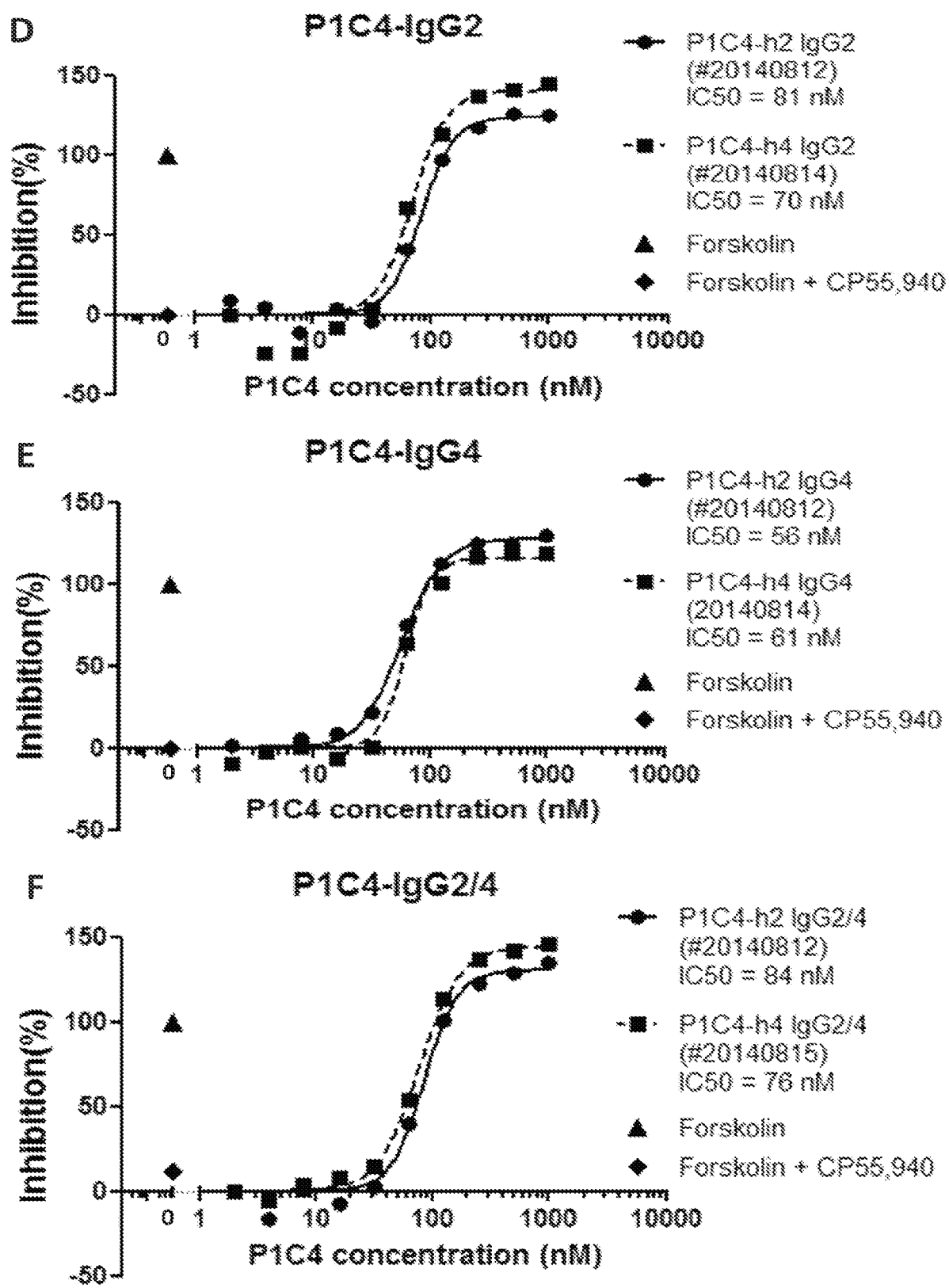

Activities of humanized PA13R3-P1C4 antibodies in this assay were compared with parental chimeric PA13R3-P1C4, rimonabant, a small molecule inverse agonist of CB1, and P2A12 mAb, a non-GPCR targeting mAb negative control antibody of IgG1 isotype. PA13R3-P1C4 mAb and its humanized variants dose-dependently inhibited CP55,940-induced reduction in intracellular cAMP levels while negative control P2A12 mAb did not have any effects (FIG. 15). The mean IC50s±SD of PA13R3-P1C4 humanized variants are listed in Table 13.

TABLE 13

Summary of IC$_{50}$ of humanized P1C4 variants determined by cAMP antagonist assay

| | cAMP IC50 (nM) Mean ± SD [n] | cAMP IC50 (nM) Mean of Batch 1 [n] | cAMP IC50 (nM) Mean of Batch 2 [n] | cAMP IC50 (nM) CHO-S [n] |
|---|---|---|---|---|
| Chimeric P1C4-IgG | 138 ± 21 [6] # | 120 ± 11 [3] | 155 ± 8 [3] | N/A |
| P1C4-h0-IgG1 | 195 ± 96 [5] # | 158 ± 57 [4] | 343 [1] | N/A |
| P1C4-h2-IgG1 | 41 ± 4 [3] **, ## | 41 ± 4 [3] | N/A | N/A |
| P1C4-h2-IgG2 | 84 ± 13 [6] **, ## | 77 ± 13 [3] | 91 ± 11 [3] | N/A |
| P1C4-h2-IgG4 | 61 ± 13 [7] **, ## | 54 ± 8 [3] | 63 ± 17 [3] | 72 [1] |
| P1C4-h2-IgG2/4 | 79 ± 13 [6] **, ## | 74 ± 14 [3] | 85 ± 13 [3] | N/A |
| P1C4-h4-IgG1 | 42 ± 7 [6] **, ## | 40 ± 6 [3] | 44 ± 7 [3] | N/A |
| P1C4-h4-IgG2 | 81 ± 19 [6] **, ## | 82 ± 28 [3] | 80 ± 13 [3] | N/A |
| P1C4-h4-IgG4 | 54 ± 9 [7] **, ## | 54 ± 12 [3] | 54 ± 11 [3] | 51 [1] |
| P1C4-h4-IgG2/4 | 80 ± 17 [6] **, ## | 69 ± 9 [3] | 90 ± 17 [3] | N/A |
| Rimonabant | 417 ± 82 [3]* | N/A | N/A | N/A |

*$p < 0.05$,
** $p < 0.005$; and compared to rimonabant,
$p < 0.05$,
$p < 0.02$.

Humanized P1C4-h2 and h4 variants were more potent (1.6-3.3 fold) than chimeric PA13R3-P1C4 mAb in a cAMP antagonist assay ($p<0.005$). P1C4-h2 and P1C4-h4 humanized variants had comparable potency, while among the different isotypes of humanized PA13R3-P1C4 variants, a trend of higher potency of the IgG1 and IgG4 variants versus the IgG2 and IgG2/4 variants was observed.

We further characterized the mechanism of PA13R3-P1C4 humanized variant antibody antagonism, in particular whether such antibodies behave as CB1 inverse agonists or neutral antagonists. Rimonabant (SR141716A), a known CB1 inverse agonist, and AM6545, a known CB1 neutral antagonist, were used as reference compounds.

To characterize whether PA13R3-P1C4 humanized variant antibodies acts as an inverse agonist or neutral antagonist, a cAMP assay was performed in the absence of exogenous agonist. Forskolin, a nonspecific adenylyl cyclase activator, was added to assay media to elevate basal cAMP levels to within the limits of detection. The cAMP agonist functional assay (Cisbio) was performed on white 384-well low volume plates (Greiner). Eight thousand cells/well in serum free Ham's F12 media of human CB1 expressing TRex-CHO cells were seeded to the plate followed by incubating mAb or control compounds at various concentrations at 22° C. for 10 minutes. Five μM forskolin (Sigma Aldrich) was added to the cells and incubated for 30 minutes at 22° C. After a 30 minute incubation at 22° C., 5 μL cAMP-d2 (1:39 dilution with conjugate and lysis buffer provided by Cisbio) and 5 μL anti-cAMP cryptate (1:9 dilution with conjugate and lysis buffer provided by Cisbio) was added to the cells and incubated for 1 hour. FRET signal was detected with the Envision multilabel plate reader (Perkin Elmer) at anti-cAMP cryptate excitation at 620 nm and emission at 665 nm. Data analysis was performed using GraphPad Prism.

Figure 16:
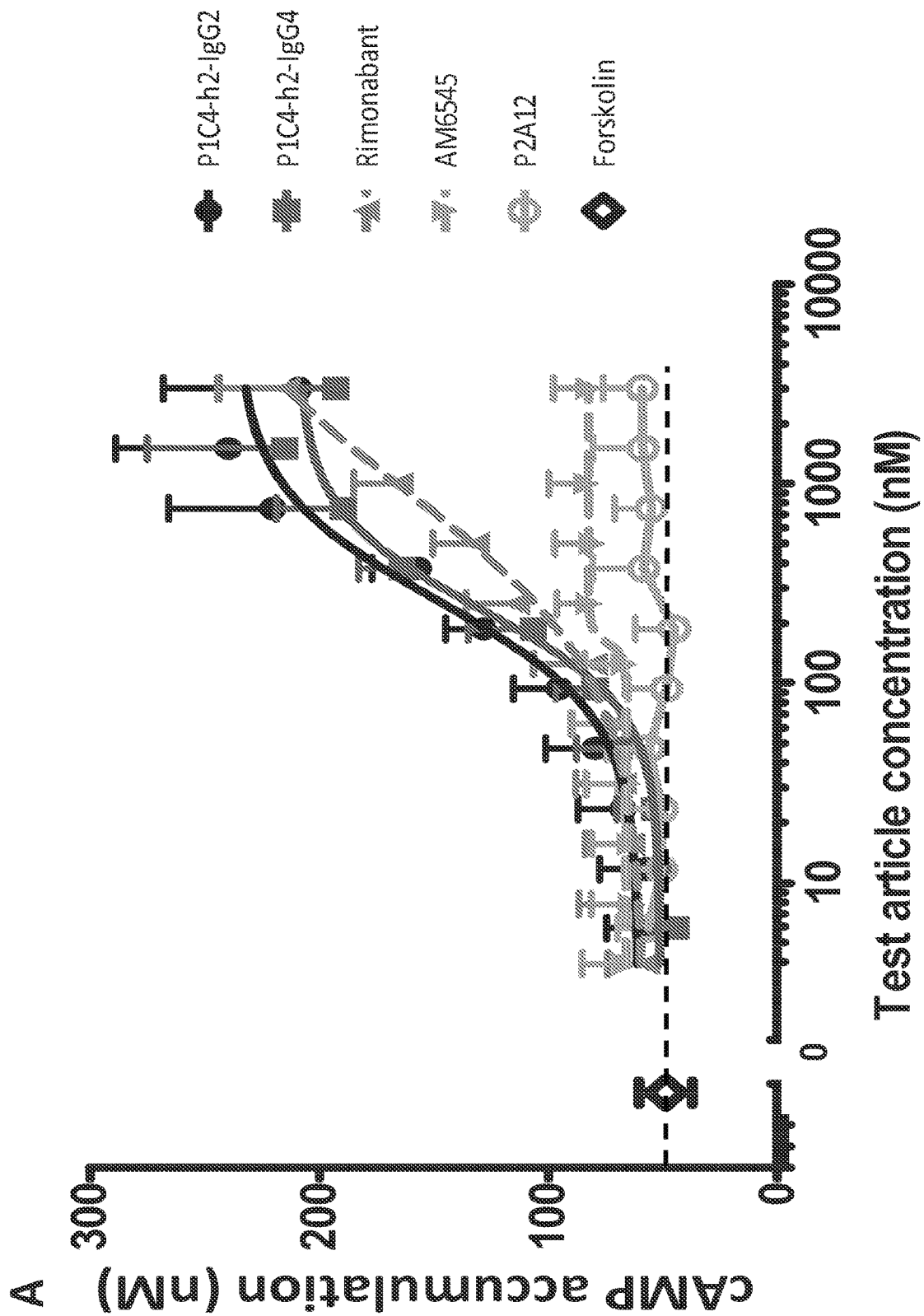
FIG. 16 shows a comparison of the activity of humanized variants P1C4-h2-IgG2 and P1C4-h2-IgG4 with rimonabant, AM6545 and the P2A12-IgG1 negative control antibody in 1.5 µM forskolin stimulated TRex-CHO CB1 cells (FIG. 16A) as well as 5 µM forskolin stimulated TRex-CHO CB1 cells (FIG. 16B).
Figure 16:
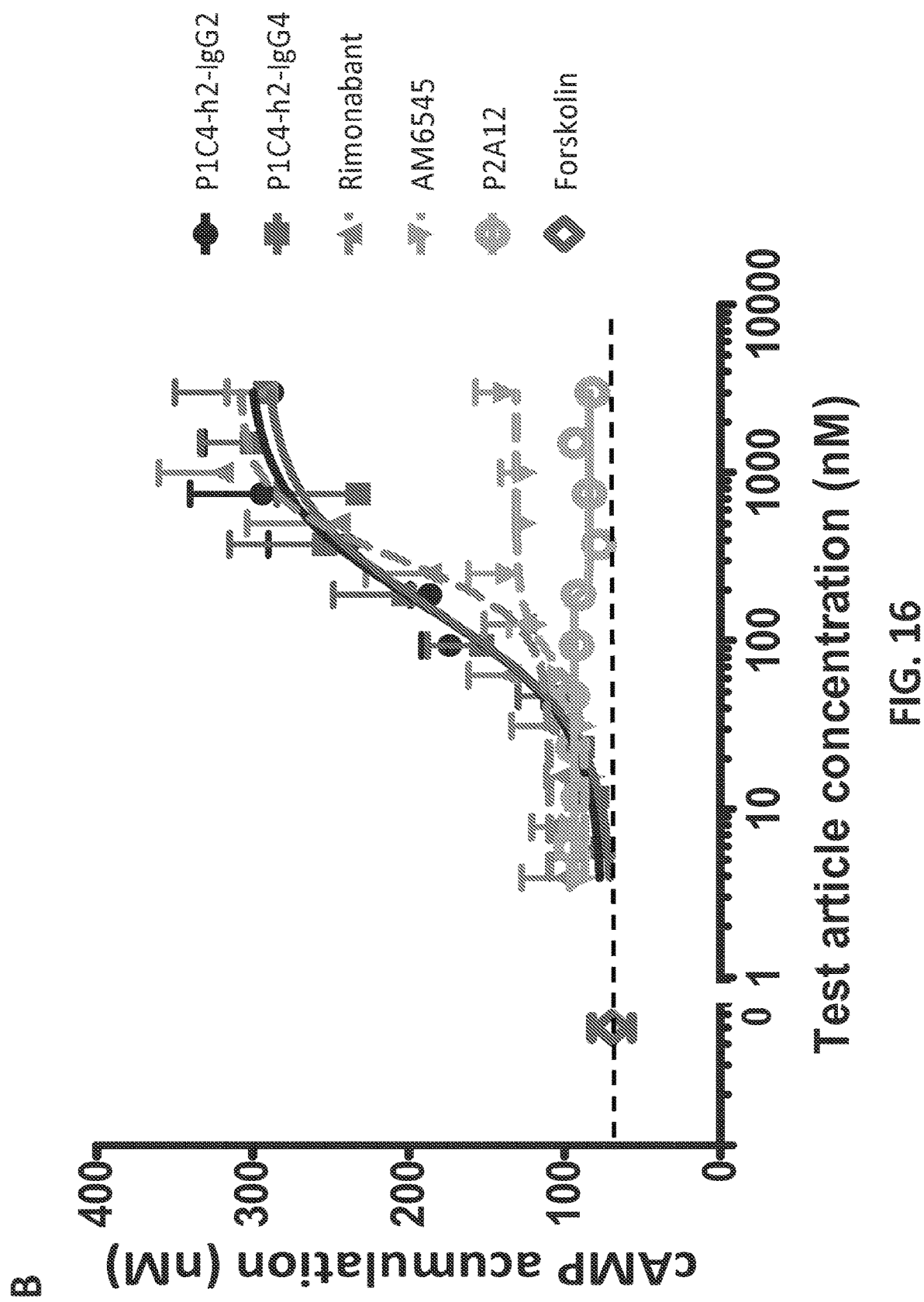
Figure 17A:
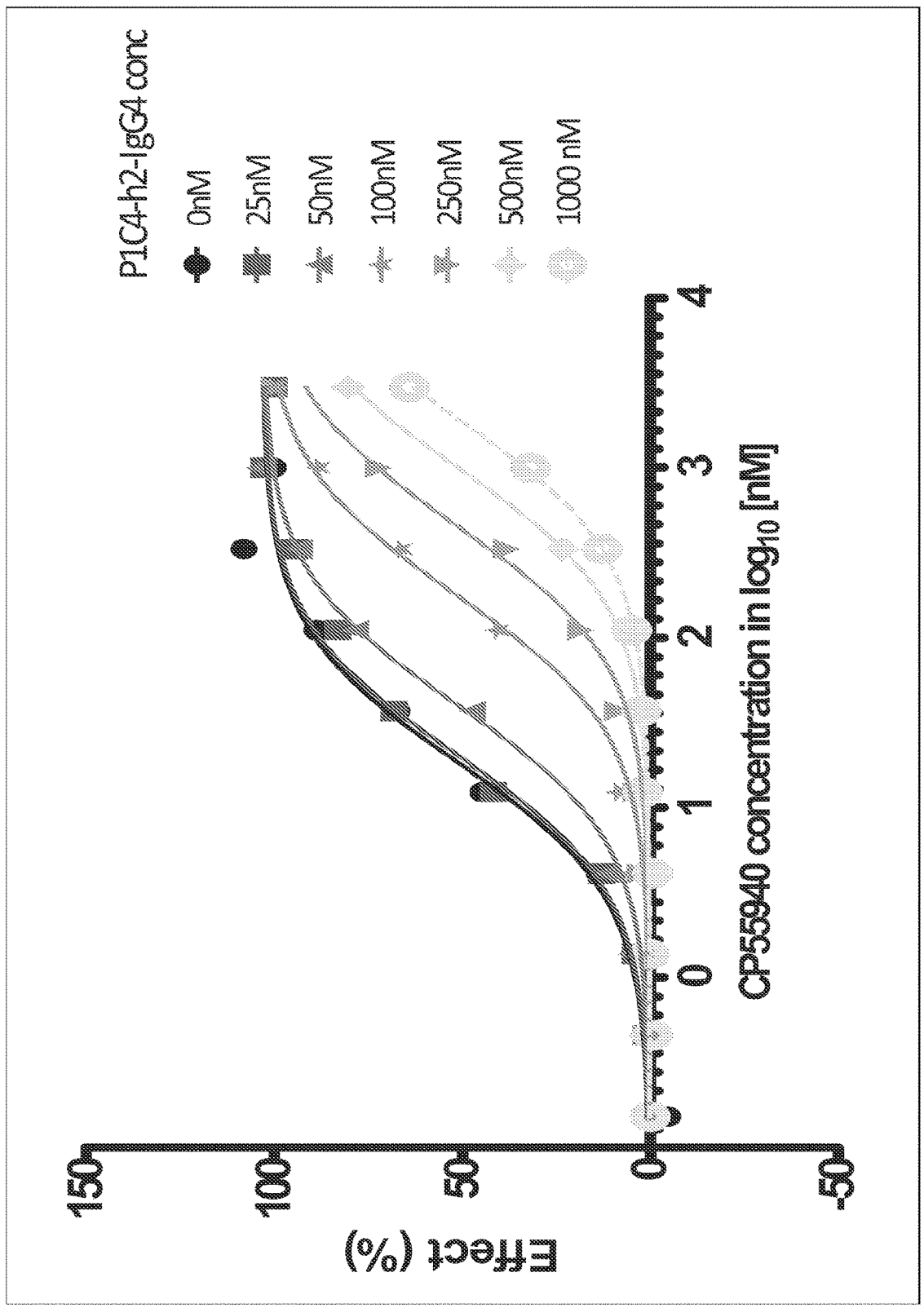
FIG. 17 shows the effect of increasing P1C4-h2-IgG4 concentrations on CP55,940 (FIG. 17A and WIN55,212 (FIG. 17C). Schild plots for each treatment are also shown (FIGS. 17B and 17D).
Figure 17B:
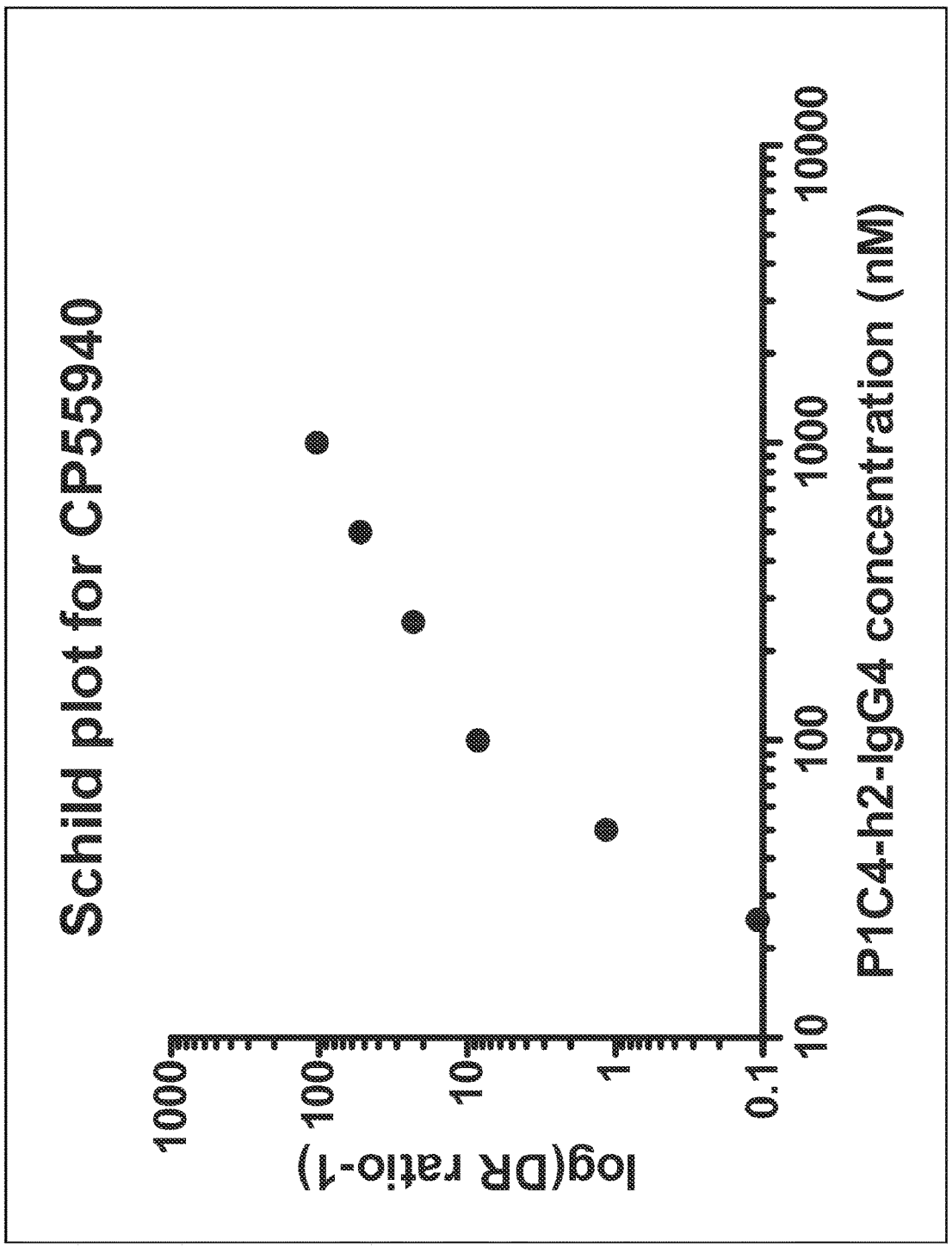
Figure 17C:
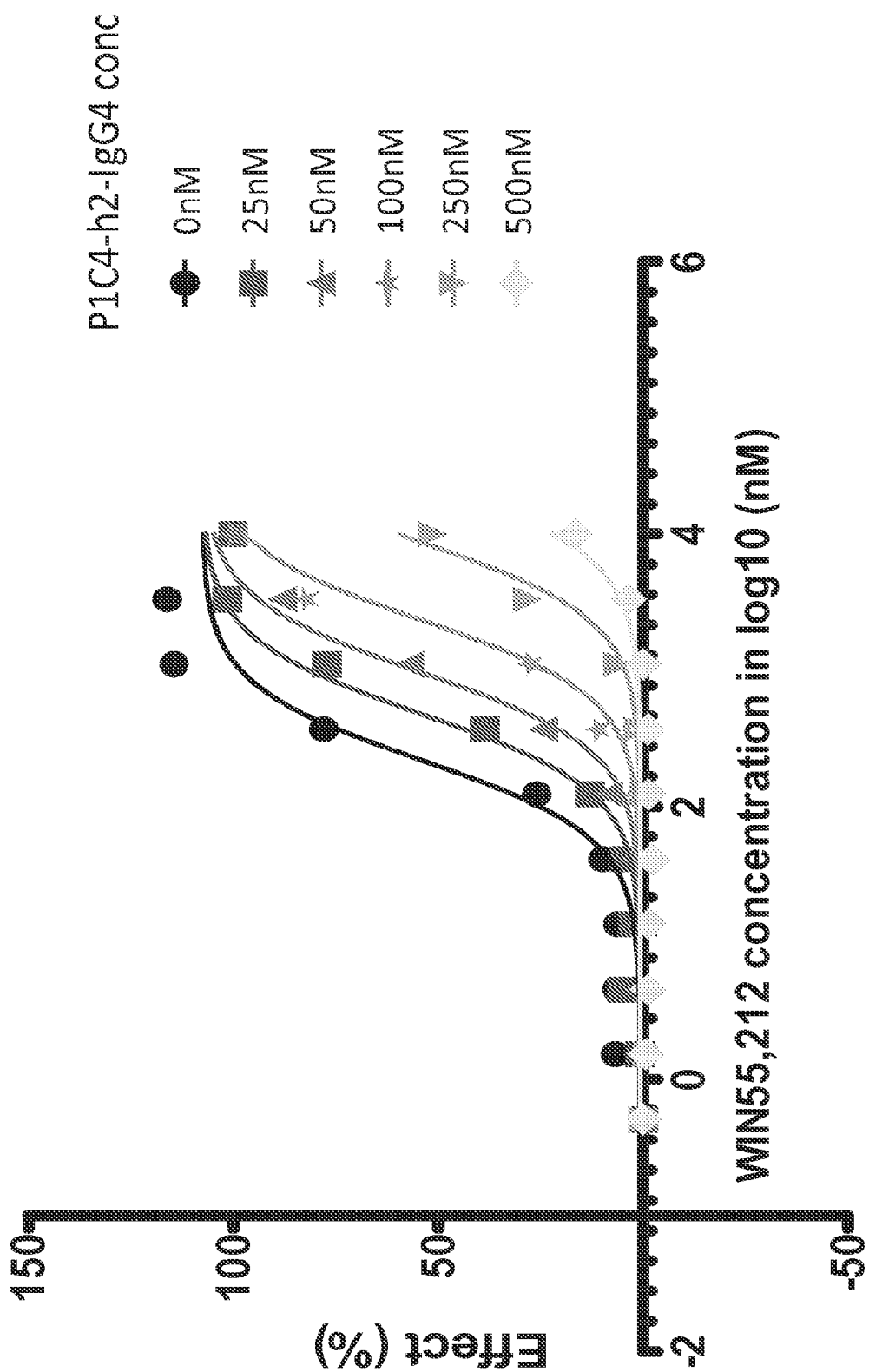
Figure 17D:
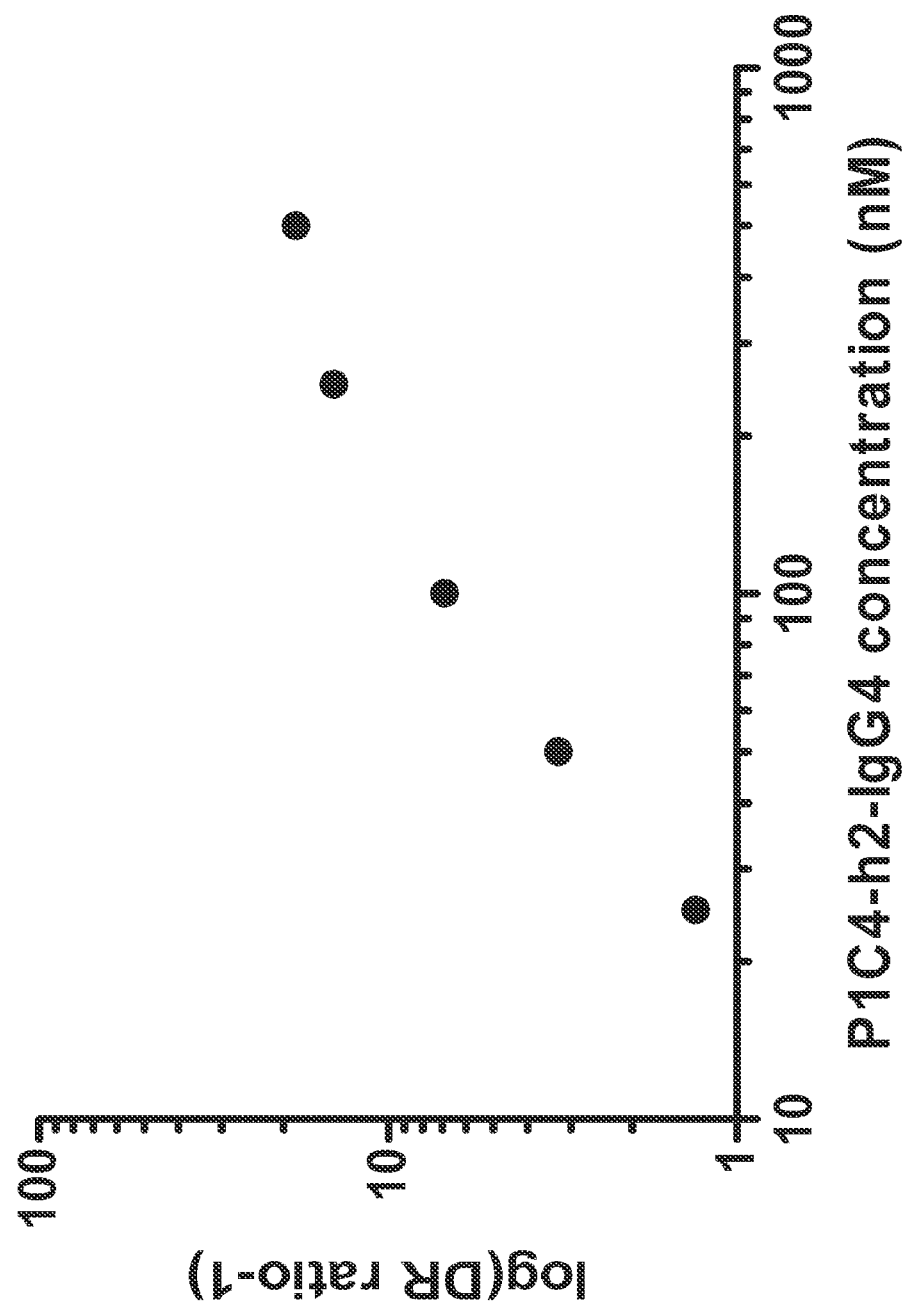

We compared the activity of humanized variants P1C4-h2-IgG2 and P1C4-h2-IgG4 with rimonabant, AM6545 and the P2A12-IgG1 negative control antibody in 1.5 μM forskolin stimulated TRex-CHO CB1 cells (FIG. 16A) as well as 5 μM forskolin stimulated TRex-CHO CB1 cells (FIG. 16B). The results show that P1C4-h2-IgG1, P1C4-h2-IgG2, P1C4-h2-IgG4, and rimonabant dose-dependently increased cAMP levels, which are indicative of an inverse agonist mechanism. In contrast, the CB1 neutral antagonist AM6545 and the P2A12-IgG1 negative control antibody did not affect cAMP levels.

Schild plot analysis was performed to determine the equilibrium dissociation constant ($K_B$), which is the measure of the binding affinity of the antagonist for its receptor independent of the nature and concentration of agonist used. Dose response curves of CB1 agonists CP55,940 and WIN55,212 in cAMP HTRF antagonist assays were determined in the presence of various concentrations of P1C4-h2-IgG4.

FIGS. 17A-D show the effect of increasing P1C4-h2-IgG4 concentrations on CP55,940 and WIN55,212 induced CB1 activity by cAMP assay (respectively). The dose ratio (R) was calculated based on EC50 of CP55,940 or WIN55,212 by which concentration of CB1 agonists (CP55,940 or WIN55,212) needs to be increased by to obtain the same response in the presence of P1C4-h2-IgG4 as was obtained in its absence. Tables 14 and 15 below shows the Schild slope and equilibrium dissociation constant ($K_B$) measured from 4 different experiments.

TABLE 14

Schild slope and equilibrium dissociation constant CP55,940

| CP55,940 | Experiment 1 | Experiment 2 | Experiment 3 | Experiment 4 |
|---|---|---|---|---|
| Schild Slope | 1.75 | 1.755 | 1.32 | 1.44 |
| $K_B$ (nM) | 48 | 15 | 26 | 28 |

TABLE 15

Schild slope and equilibrium dissociation constant WIN55,212

| WIN55,212 | Experiment 1 | Experiment 2 | Experiment 3 | Experiment 4 |
|---|---|---|---|---|
| Schild Slope | 1.4 | 2.1 | 1.5 | 1.6 |
| $K_B$ (nM) | 21 | 17 | 22.4 | 28 |

Example 19. ERK Activation Assay for PA13R3-P1C4 Humanized Variants

We showed in Example 10 and FIG. 5A that parental antibody PA13R3-P1C4 blocks WIN55,212 induced ERK activation. To confirm that PA13R3-P1C4 humanized variants also block WIN55,212 induced ERK activation we tested the ability of these antibodies to inhibit WIN55,212 induced ERK phosphorylation.

Two days before the experiment, Trex-CHO CB1 receptor-expressing cells were seeded at 500,000 cells/well into 6-well plates. 1 μg/mL tetracycline was used to induce CB1 receptor expression after 24 hours. Cells were serum starved for at least two hours before the experiment. Purified IgGs at 300 nM were added to the culture media, after 30 minutes, cells were stimulated with CB1 receptor agonist WIN55,212 (100 nM) for 10 and 15 minutes. Cell lysates were harvested and the level of ERK activation was determined by western blot. Anti-ERK and Anti-phospho-specific ERK antibodies were obtained from Cell Signaling Inc.

Figure 18:
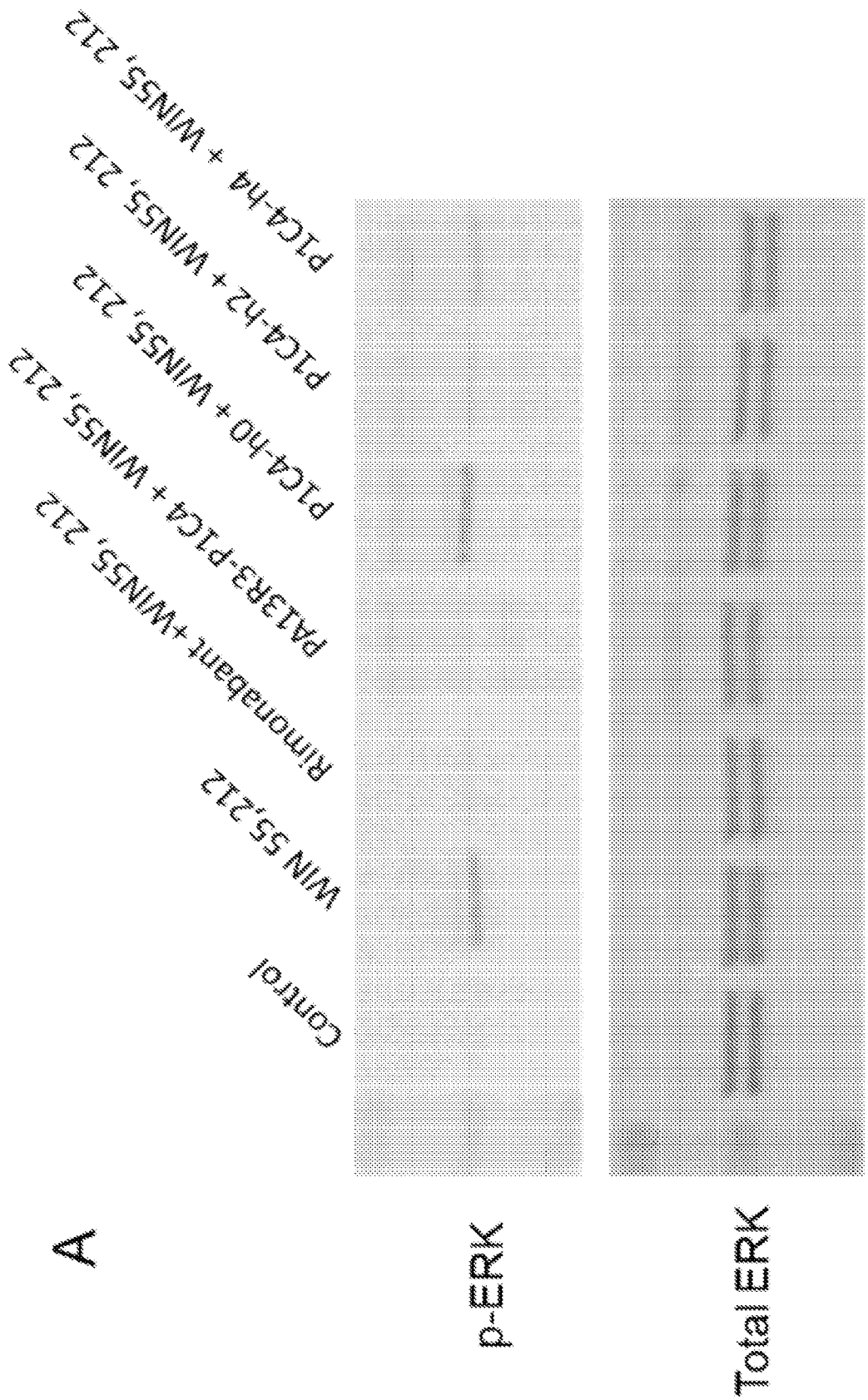
FIGS. 18A and 18B show Western blot ERK activation assays measuring the ability of PA13R3-P1C4 humanized variants to block WIN55,212 mediated ERK activation.
Figure 18:
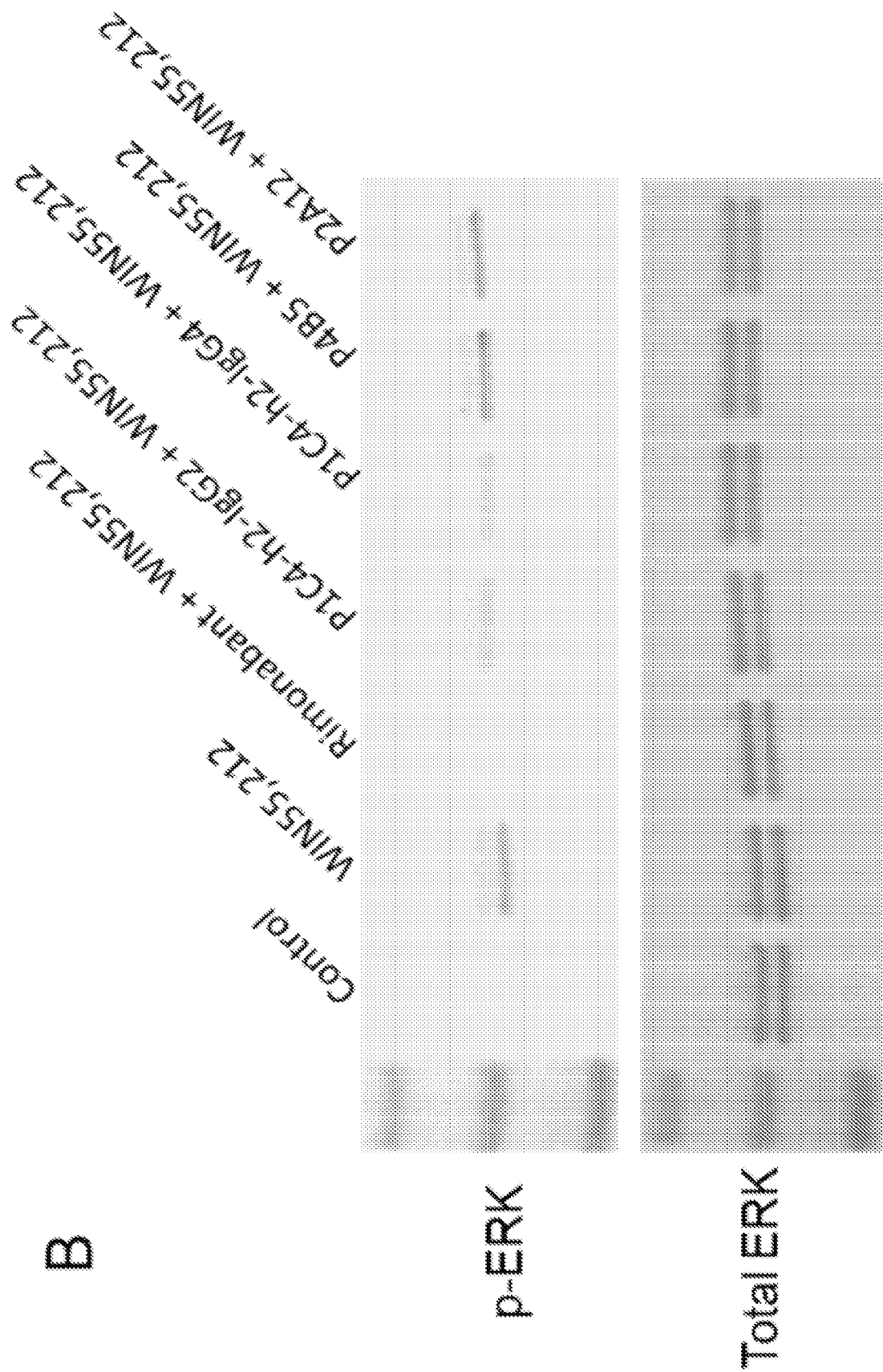

As shown in FIG. 18A treatment with CB1 agonist WIN55,212 increased the level of phosphorylated ERK suggesting that the CB1 receptor signals through the ERK pathway. Pre-treatment with CB1-specific antagonist rimonabant inhibited the WIN55,212-induced ERK activation. Similar to rimonabant, pre-treatment with anti-CB1 antibodies P1C4-h2-IgG1 and P1C4-h4-IgG1 inhibited WIN55,212 induced ERK activation (FIG. 18A). P1C4-h0-IgG1 did not inhibit WIN55,212 induced ERK activation. This is consistent with the cAMP antagonist assay, which showed that P1C4-h0-IgG1 is less potent than other humanized P1C4 variants and the lack of effect on blocking WIN55,212 induced ERK activation was hypothesized.

The effect of P1C4-h2 in IgG2 and IgG4 frameworks on WIN55,212 activated ERK pathway was also examined. Similar to chimeric PA13R3-P1C4 and humanized P1C4-h2-IgG1, pre-treatment with CB1 antibodies P1C4-h2-IgG2 and P1C4-h2-IgG4 blocked WIN55,212 induced ERK phosphorylation (FIG. 18B). Non-GPCR targeting mAb P2A12 did not block WIN55,212 induced ERK activation. These results indicate that these Fc frameworks do not affect the antagonist characteristics of PA13R3-P1C4.

Example 20. CB1 Receptor Internalization Study for PA13R3-P1C4 Humanized Variants Flow cytometry was used to characterize the activity of PA13R3-P1C4 and humanized variant antibodies in a CB1 receptor internalization assay in the presence or absence of agonist or antagonist compounds.

On the day of the experiment, cells were serum starved for 2 hours. Cells were then pre-incubated with CB1 antibody (300 nM), AM6545 (CB1 neutral antagonist) and negative control (BRIL binder) for half an hour. CB1 agonist (1 μM WIN55,212) was then added to the culture media for 1 hour to induce receptor internalization. Surface expression of CB1 was stained with anti-CB1 N-terminus mouse monoclonal antibody from R&D and the mean fluorescence intensity (MFI) was determined using flow cytometry (Guava).

Figure 19A:
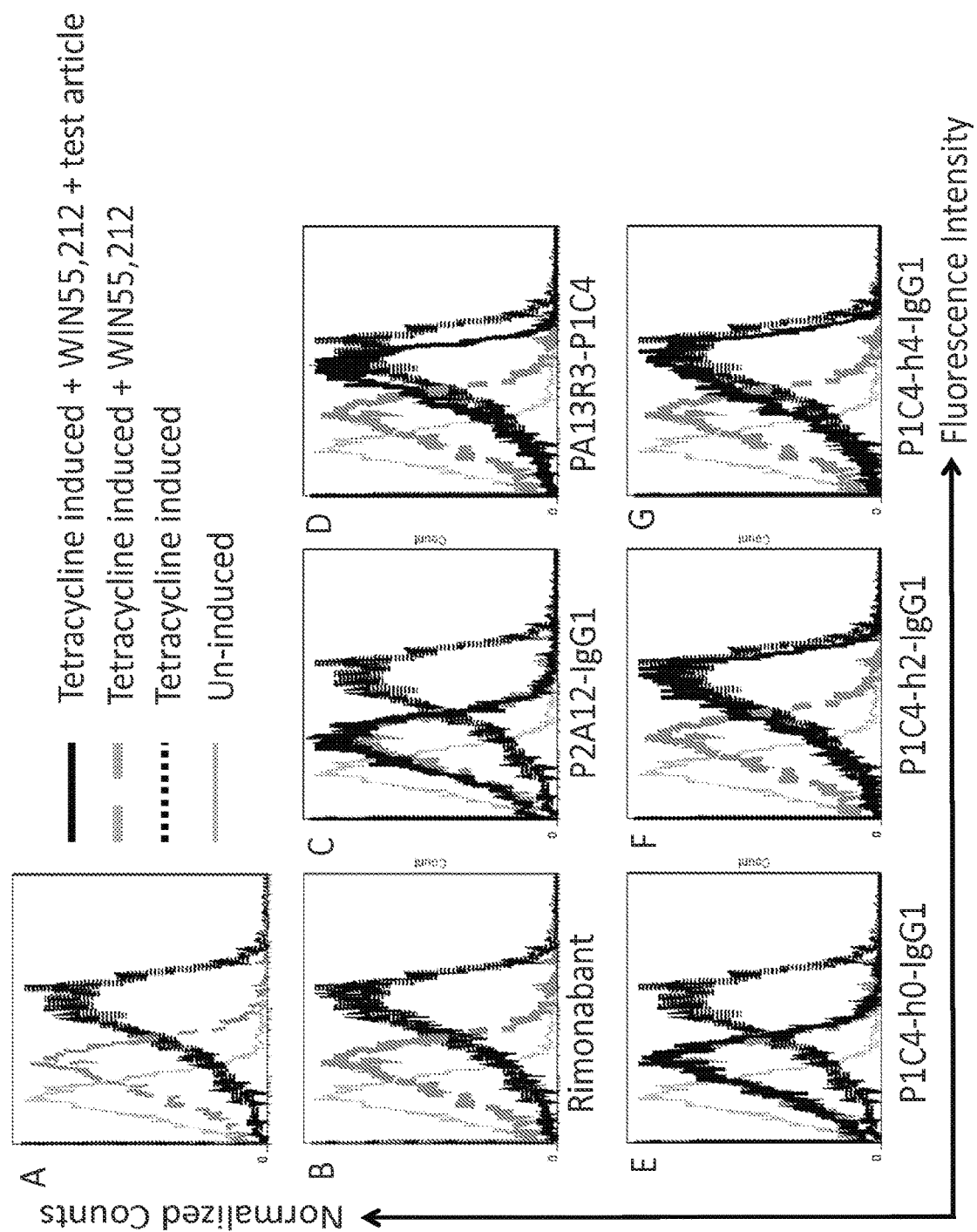
FIG. 19A shows a flow-cytometry based CB1 receptor internalization study under various induction conditions, in the absence of inhibitor (Panel A), or the presence of rimonabant (Panel B) or PA13R3-P1C4 humanized variants (Panels C-G).

CB1 expression in TRex-293 cells was induced by tetracycline as evident by the increase in surface staining using a mouse monoclonal antibody targeting the CB1 N-terminus (FIG. 19A, Panel A, dotted trace). Treatment with tetracycline and CB1 agonist WIN55,212 reduced surface staining indicating the loss of CB1 on cell surface through internalization (FIG. 19A, Panel A, dashed trace). Pre-treatment with CB1-specific antagonist rimonabant (FIG. 19A, Panel B, solid black trace) inhibited the agonist-induced reduction in cell surface CB1 staining. Similar to rimonabant, pre-treatment with anti-CB1 antibodies (PA13R3-P1C4 (FIG. 19A, Panel D, solid black trace), P1C4-h2-IgG1 (FIG. 19A, Panel F, solid black trace) and P1C4-h4-IgG1 (FIG. 19A, Panel G, solid black trace)) inhibited WIN55,212 induced CB1 receptor internalization. P1C4-h0-IgG1 (FIG. 19A, Panel E, solid black trace) and negative control antibody P2A12-IgG1 (FIG. 19A, Panel C, solid black trace) did not inhibit WIN55,212 induced CB1 internalization. Consistent with the cAMP antagonist and ERK activation assays, P1C4-h0-IgG1 is less potent than other humanized P1C4 variants and the lack of effect on blocking WIN55,212 induced receptor internalization may be due to the high off-rate of P1C4-h0-IgG1.

Figure 19B:
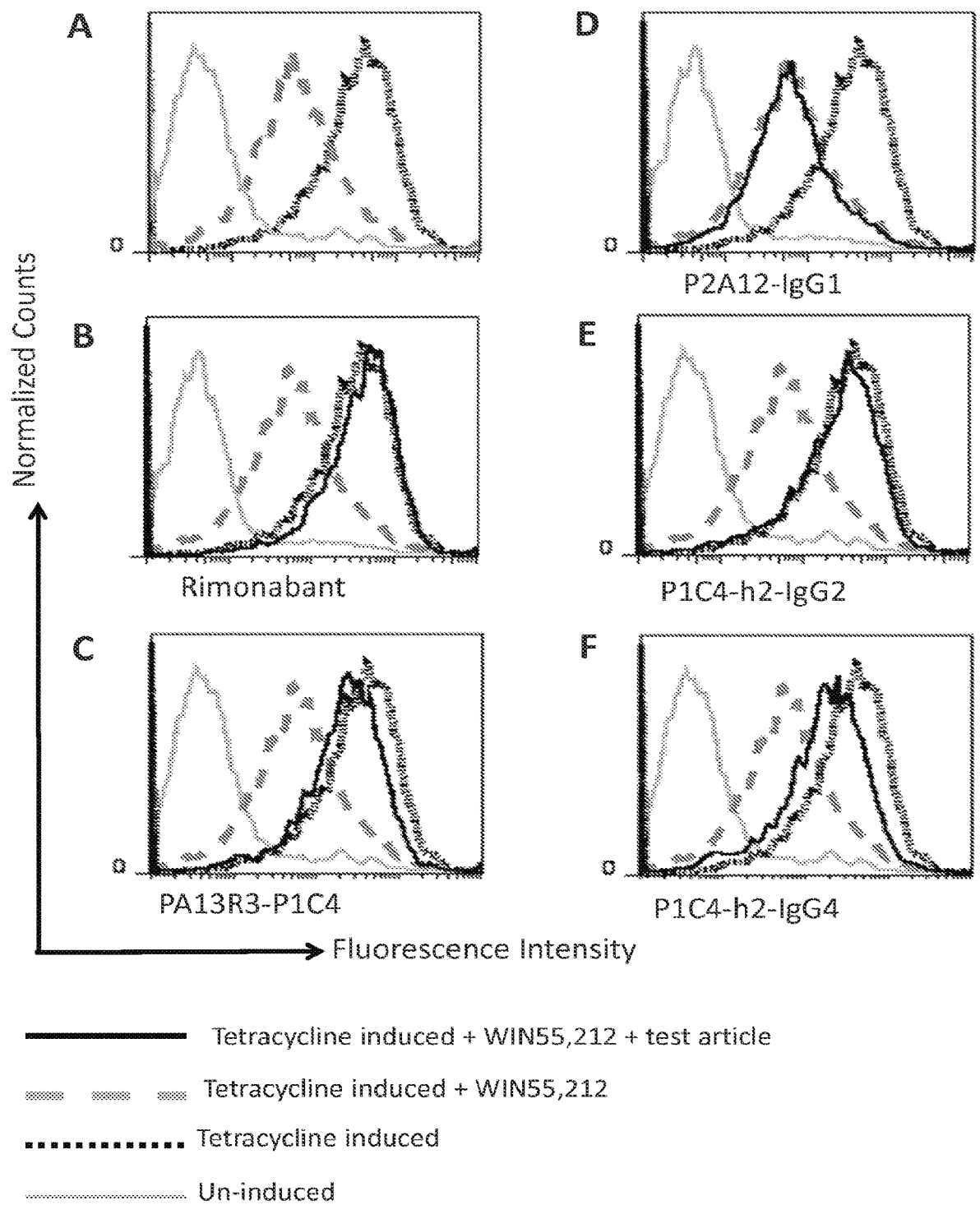
FIG. 19B shows the same CB1 receptor internalization assay investigating the effect of P1C4-h2 cloned into the different human Fc frameworks IgG2 and IgG4.
Figure 20:
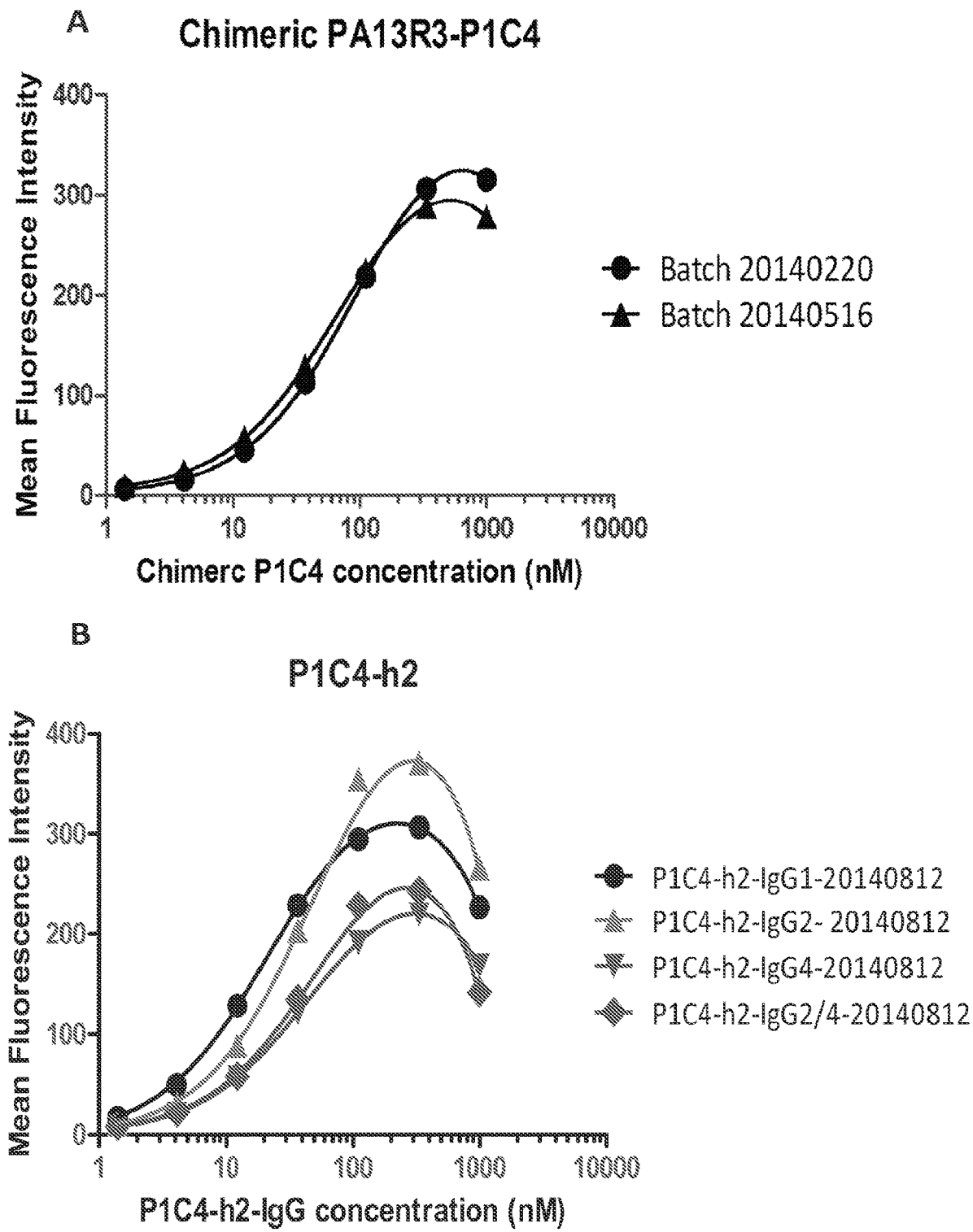
FIG. 20, A-D show flow cytometry data measuring binding of humanized PA13R3-P1C4 antibody variants to TRex-CHO cells stably transfected with tetracycline inducible human CB1.
Figure 20:
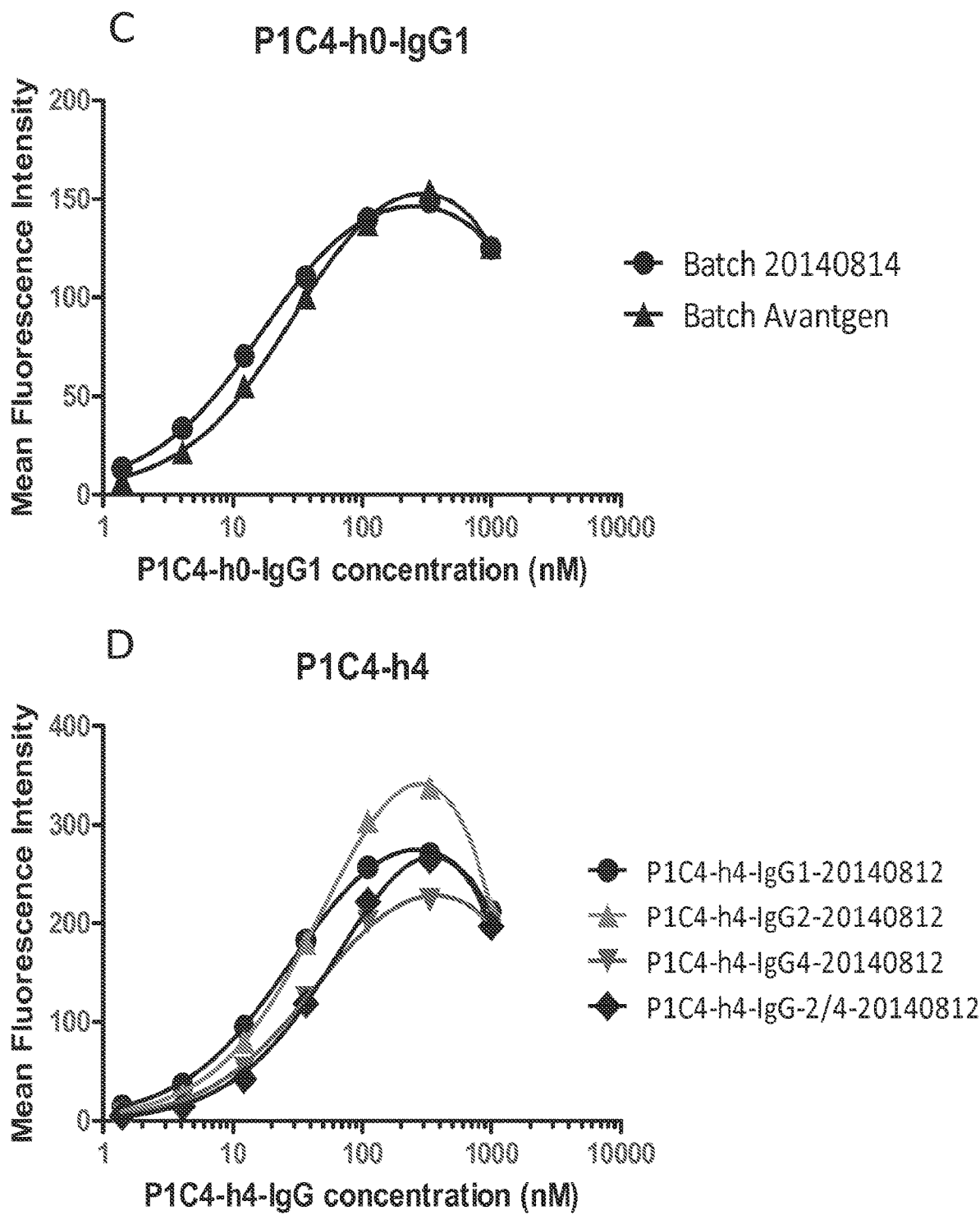
Figure 20:
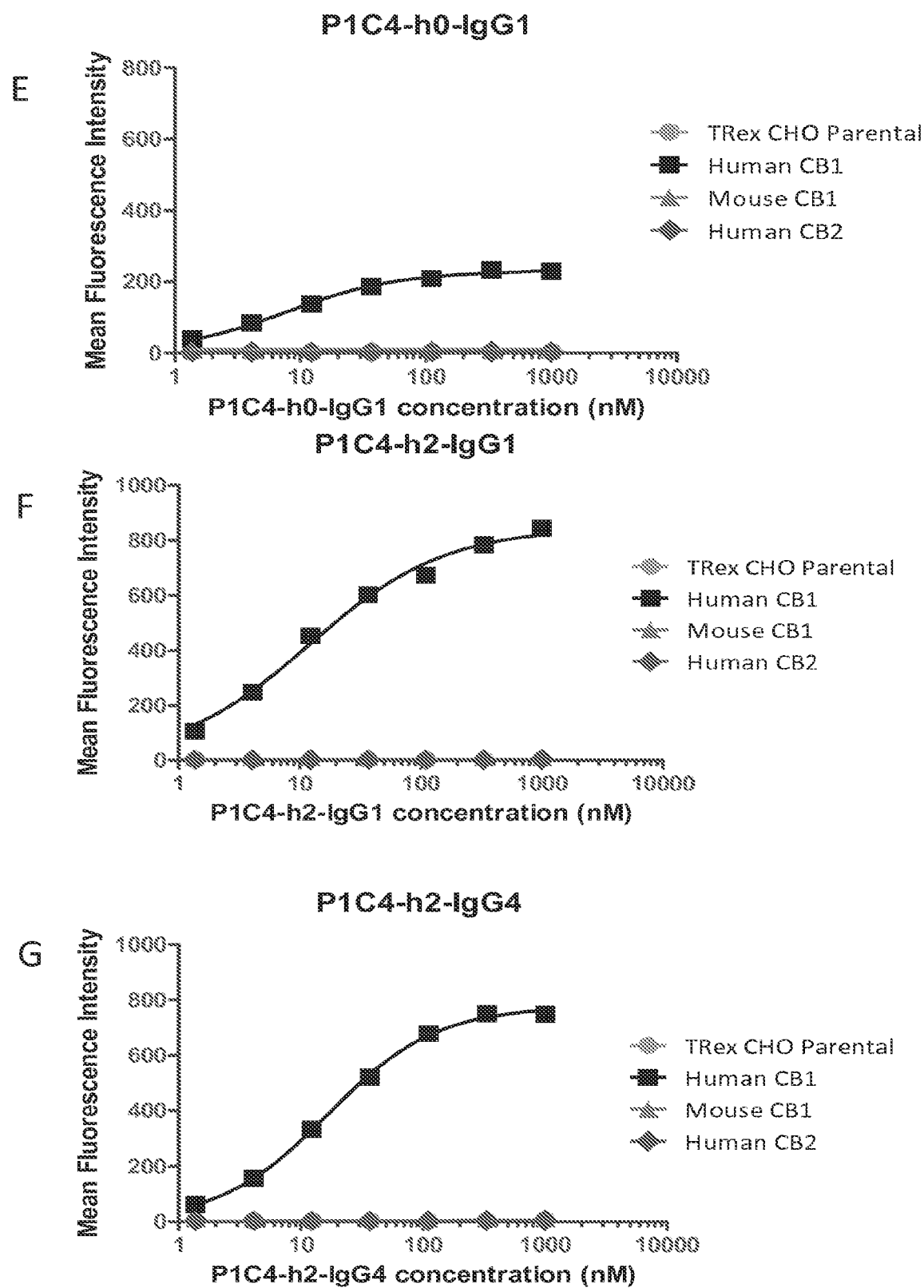
Figure 20:
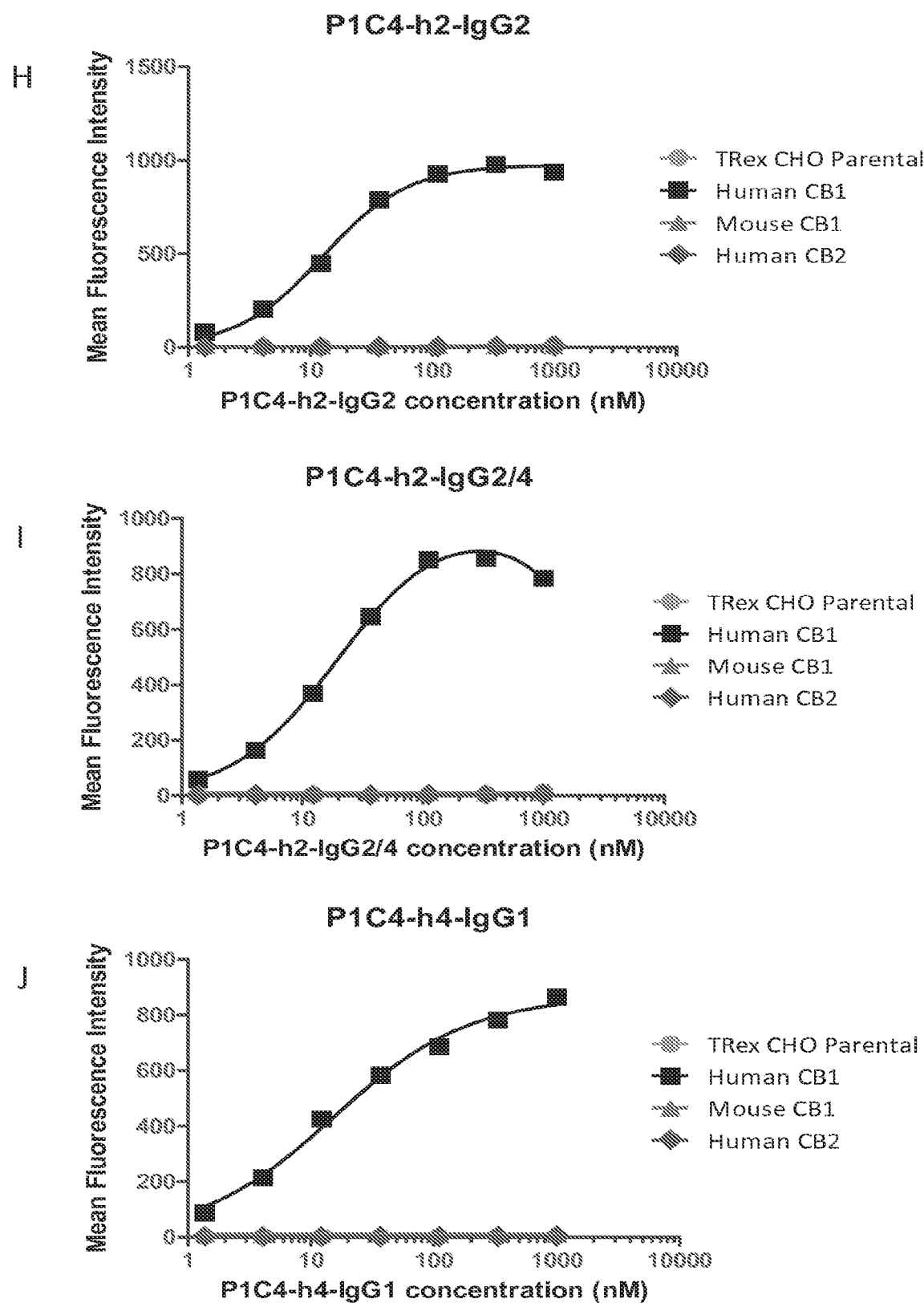
Figure 20:
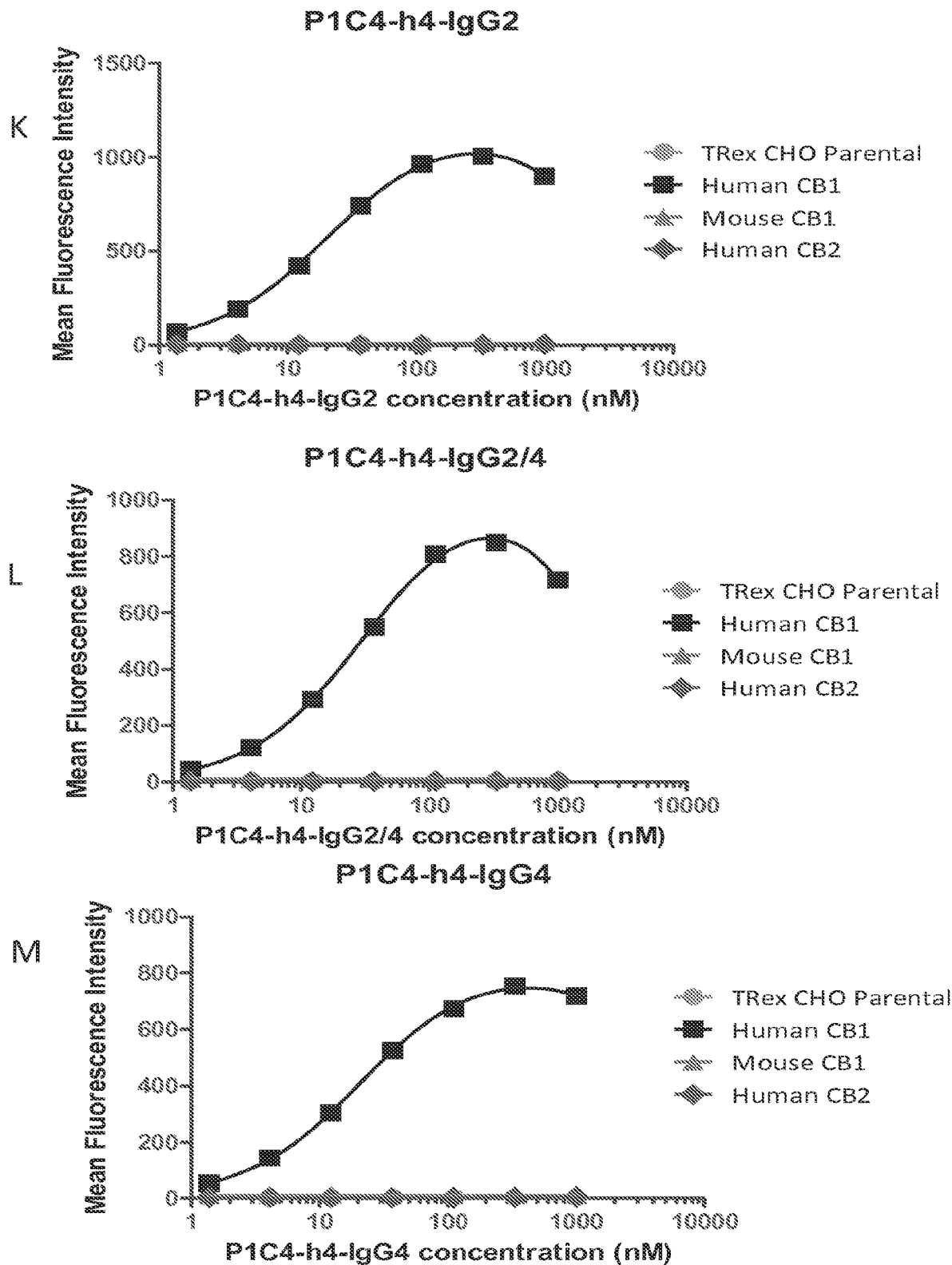

Among the different human IgG subclasses, the Fc regions of IgG2 and IgG4 subclasses bind poorly to effector molecules, such as activating FcγRs and to complement 1 q (C1q), resulting in lower effector function activity. As such, P1C4-h2 was cloned into human Fc frameworks IgG2 and IgG4 as for our therapeutic applications activation of immune effector functions is undesired (discussed in Example 17). Humanized variants P1C4-h2-IgG1, P1C4-h4-IgG1, P1C4-h2-IgG2 and P1C4-h2-IgG4 were then assayed for blockade of CB1 receptor internalization. As above, CB1 expression in TRex-293 cells was induced by tetracycline as was evident by the increase in surface staining using a mouse monoclonal antibody targeting the CB1 N-terminus (FIG. 19B, Panel A, dotted trace). Treatment with tetracycline and CB1 agonist WIN55,212 reduced surface staining indicating the loss of CB1 on cell surface through internalization (FIG. 19B, Panel A, dashed trace). Pre-treatment with CB1-specific antagonist rimonabant (FIG. 19B, Panel B, solid black trace) inhibited the agonist-induced reduction in cell surface CB1 staining. Similar to rimonabant, pre-treatment with anti-CB1 antibodies (PA13R3-P1C4 (FIG. 19B, Panel D, solid black trace), P1C4-h2-IgG1 (FIG. 19B Panel F, solid black trace) and P1C4-h4-IgG1 (FIG. 19B, Panel G, solid black trace)) inhibited WIN55,212 induced CB1 receptor internalization. P1C4-h0-IgG1 (FIG. 19B, Panel E, solid black trace) and negative control antibody P2A12-IgG1 (FIG. 19B, Panel C, solid black trace) did not inhibit WIN55,212 induced CB1 internalization.

Example 21. Binding of Humanized PA13R3-P1C4 Antibody Variants by Flow Cytometry The binding affinity of PA13R3-P1C4 humanized variants was determined by flow cytometry using TRex CHO cells stably transfected with the CB1. TRex CHO parental cells, and TRex-CHO cells stably transfected with tetracycline inducible human CB1, human CB2 or mouse CB1 expression constructs were harvested. To determine binding of test antibodies, one hundred microliters of $1\times10^6$ cells/mL of cells were incubated with test antibodies with a range of concentrations between 1 µM and 1.3 nM for 30 minutes on ice. Cells were then centrifuged at 4° C. at 1600 rpm for 3 minutes; supernatant was aspirated and cells were washed with 200 µL FACS buffer. The washing procedure was repeated twice. After the final wash, cells were re-suspended in FACS buffer containing PE-conjugated anti-human Fc secondary antibody (1:200 dilutions) and incubated at 4° C. for 30 minutes. Cells were washed with 200 µL FACS buffer twice and analyzed by flow cytometry (Guava). Data analysis and measurement of binding affinity ($K_D$) was performed using GraphPad Prism software. The mean dissociation constant ($K_D$) of PA13R3-P1C4 humanized variants was determined by averaging at least 4 different experiments using at least 2 different batches of protein (FIG. 20A-D and Table 16).

TABLE 16

Mean dissociation constant ($K_D$) of PA13R3-P1C4 humanized variants

| | Binding Affinity | Binding Affinity $K_D$ (nM) | | |
|---|---|---|---|---|
| | $K_D$ (nM) Mean ± SD [n] | Mean of Batch 1 [n] | Mean of Batch 2 [n] | Mean of Batch 3 [n] |
| PA13R3-P1C4 | 103 ± 18 [7] | 92 [3] | 116 [3] | 96 [1] |
| P1C4-h0-IgG1 | 24 ± 6 [7] *** | 23 [4] | 24 [3] | 24 [3] |
| P1C4-h2-IgG1 | 41 ± 18 [4] ** | 41 [4] | N/A | N/A |
| P1C4-h2-IgG2 | 78 ± 24 [6] | 74 [3] | 77 [3] | N/A |
| P1C4-h2-IgG4 | 57 ± 11 [7] *** | 59 [3] | 59 [3] | 43 [1] |
| P1C4-h2-IgG2/4 | 82 ± 24 [6] | 82 [3] | 82 [3] | N/A |
| P1C4-h4-IgG1 | 37 ± 12 [7] *** | 37 [4] | 37 [3] | N/A |
| P1C4-h4-IgG2 | 65 ± 26 [6] * | 65 [3] | 65 [3] | N/A |
| P1C4-h4-IgG4 | 49 ± 15 [7] *** | 51 [3] | 49 [3] | 49 [1] |
| P1C4-h4-IgG2/4 | 75 ± 41 [6] | 69 [3] | 74 [3] | N/A |

* $p < 0.05$,
** $p < 0.01$,
*** $p < 0.001$.

Humanized variants except h2-IgG2, h2-IgG2/4 and h4-IgG2/4 showed statistically significant increased binding affinity to human CB1 relative to the parental chimeric antibody PA13R3-P1C4. The mean dissociation constant for each species was determined using at least two different protein preparations (except P1C4-h2-IgG1 which has only one protein preparation). Dissociation constants of each species were comparable between different protein preparations (Table 16). The binding affinities of P1C4-h2 and P1C4-h4 variants were similar. However, a slight trend, although not statistically significant, of higher binding affinities of IgG1 variants compared to IgG2, IgG4 and IgG2/4 variants was observed.

P1C4-h0-IgG1 has the lowest apparent dissociation constant measured ($K_D$ 24 nM). However, the maximum FACS signal (mean fluorescence intensity) of P1C4-h0-IgG1 did not reach as high as the other P1C4 variants. This may indicate a higher off-rate of P1C4-h0-IgG1.

Binding selectivity and cross-reactivity of PA13R3-P1C4 and its humanized variants was also characterized by flow cytometry using TRex CHO cells stably transfected with the GPCRs of interest. Specifically, binding selectivity for CB1 over CB2 was determined. Cross reactivity to mouse CB1 was also determined. For detecting expression of mouse CB1, 100 μL of 1×10$^6$ cells/mL of cells were incubated with anti-CB1 rabbit polyclonal antibody (Santa Cruz) at 1 μg/100 μL on ice for 30 min. Mouse monoclonal anti-CB2 antibody from R&D Systems was used to confirm the expression of CB2. 100 μL of 1×10$^6$ cells/mL of cells were incubated with anti-CB2 antibody at 0.5 μg/100 μL on ice for 30 minutes. After incubation, cells were then centrifuged at 4° C. at 1600 rpm for 3 minutes; supernatant was aspirated and cells were washed with 200 μL FACS buffer. The procedure was repeated twice. After the final wash, cells were re-suspended in FACS buffer containing FITC-conjugated anti-rabbit secondary antibody (1:200 dilutions) for mouse CB1 detection and PE-conjugated anti-mouse IgG secondary antibody (1:200 dilutions) for CB2 expression and incubated at 4° C. for 30 minutes. After 30 a minute incubation with secondary antibody, cells were then centrifuged at 4° C. at 1600 rpm for 3 minutes; supernatant was aspirated to remove excess secondary antibodies. Cells were washed with 200 μL FACS buffer twice and analyzed by flow cytometry (Guava). Binding of purified IgG full concentration curves ranging from 1 μM to 1.3 nM was determined. Data analysis and measurement of binding affinity ($K_D$) was performed using GraphPad Prism software.

Binding selectivity and cross-reactivity of humanized PA13R3-P1C4 variants to human CB1 versus human CB2 and mouse CB1 are shown in FIGS. 20E-M. Similar to PA13R3-P1C4, the humanized variants bound selectively to human CB1 vs human CB2. No substantial binding to mouse CB1 was observed at concentrations up to 1 μM, indicating lack of cross-reactivity with this species despite high amino acid identity between human and mouse CB1 in the extracellular domains (97% identity).

Example 22. Swapping of ECL2 Effect on FACS Binding

To test the effect of ECL2 mutations to P1C4's ability to bind to CB1 expressed on cell surface, we built a CB1 cell expression construct by site-directed mutagenesis. Briefly, 2 oligos, Apollo_ECL2_h2m_F (CTGCAATCTGTTTGCTCAGACATTTTCCCACTCAT TGATGAAACCTACCT) (SEQ ID NO: 826) and Apollo_ECL2_h2m_R (GGAAAATGTCT GAGCAAACA-GATTGCAGTTTCTTGCAGTTCCAGCCCAGG) (SEQ ID NO: 827) were used as primers in a PCR reaction using pcDNA4TO-human CB1 as template. The reaction introduced E→K and H→L mutations in ECL2, making the human CB1 ECL2 sequence identical to murine CB1 ECL2. The 50 μL PCR reaction mixture contained 104, 5×PCR buffer, 24, dNTPs (10 mM each), 0.254, each of forward and reverse primers (10004 stock), 50 ng of template DNA, 14, DMSO, and 14, Phusion polymerase (NEB). The PCR cycles were 95° C. for 30 seconds, 55° C. 1 minute, 72° C. 7 minutes, and repeated for 16 times. After the PCR reaction was finished, 1 μL DpnI (20 U/μL) was added into PCR product. The PCR product was incubated at 37° C. for 1 hour before 1 μL it was transformed into Dh5α E. coli. The resulting transformants were plated and single colonies were sequenced to verify the mutation. The resulting construct was named as pcDNA4TO-human/mouse ECL2 swapped CB1-IRES-GFP.

To confirm the sites E→K and H→L in ECL2 were critical for PA13R3-P1C4 CB1 binding, transiently transfected TRex-CHO cells with human CB1, mouse CB1 or human/mouse ECL2 swapped expression constructs were used to investigate the binding of P1C4-h4-IgG1 by flow cytometry.

TRex-CHO cells were grown in Ham's F12 culture media supplemented with 10% fetal bovine serum, 1% penicillin and streptomycin and 10 μg/ml blasticidine. The day before transfection, cells were passaged and seed at 0.5×10$^6$ cell in 2 ml culture media per well in a 6-well plate. On the day of transfection, cells were transfected with pcDNA4TO-human CB1, pcDNA4TO-mouse CB1-IRES-GFP, pcDNA4TO-human/mouse ECL2 swapped CB1-IRES-GFP or pcDNA4TO-GFP negative control using Lipofectamine 2000 following Life Technologies' instructions. The day after transfection, cells were treated with 1 μg/ml tetracycline for 24 hours to induce CB1 expression. On the day of experiment, media were aspirated; cells were washed with DPBS once and incubated with cell dissociation buffer for 5 minutes. Cells were collected and centrifuged at 1600 rpm for 3 minutes. Supernatants were aspirated and cells were washed with DPBS. Cell counts were determined using Bio-Rad T10 cell counter. Cells were centrifuged at 1600 rpm for 3 minutes; supernatant was aspirated to remove DPBS and resuspended at 1×10$^6$ cells/mL FACS buffer (3% FBS in DPBS, 0.09% sodium azide). To determine binding of PA13R3-P1C4 mAb to human CB1, mouse CB1, human/mouse ECL2 swapped CB1 and control cells, 100 μL of 1×10$^6$ cells/mL of cells were incubated with P1C4-h4-IgG1, R&D CB1 mAb or P2A12 for 30 minutes on ice. Secondary PE-conjugated anti-human mAb or PE-conjugated anti-mouse mAb was diluted 1:200 fold in FACS buffer. Cells only stained with secondary antibody were used as negative control. After incubation with secondary antibody, cells were washed with 200 μl of FACS buffer twice and analyzed by flow cytometry (Guava).

Figure 21:
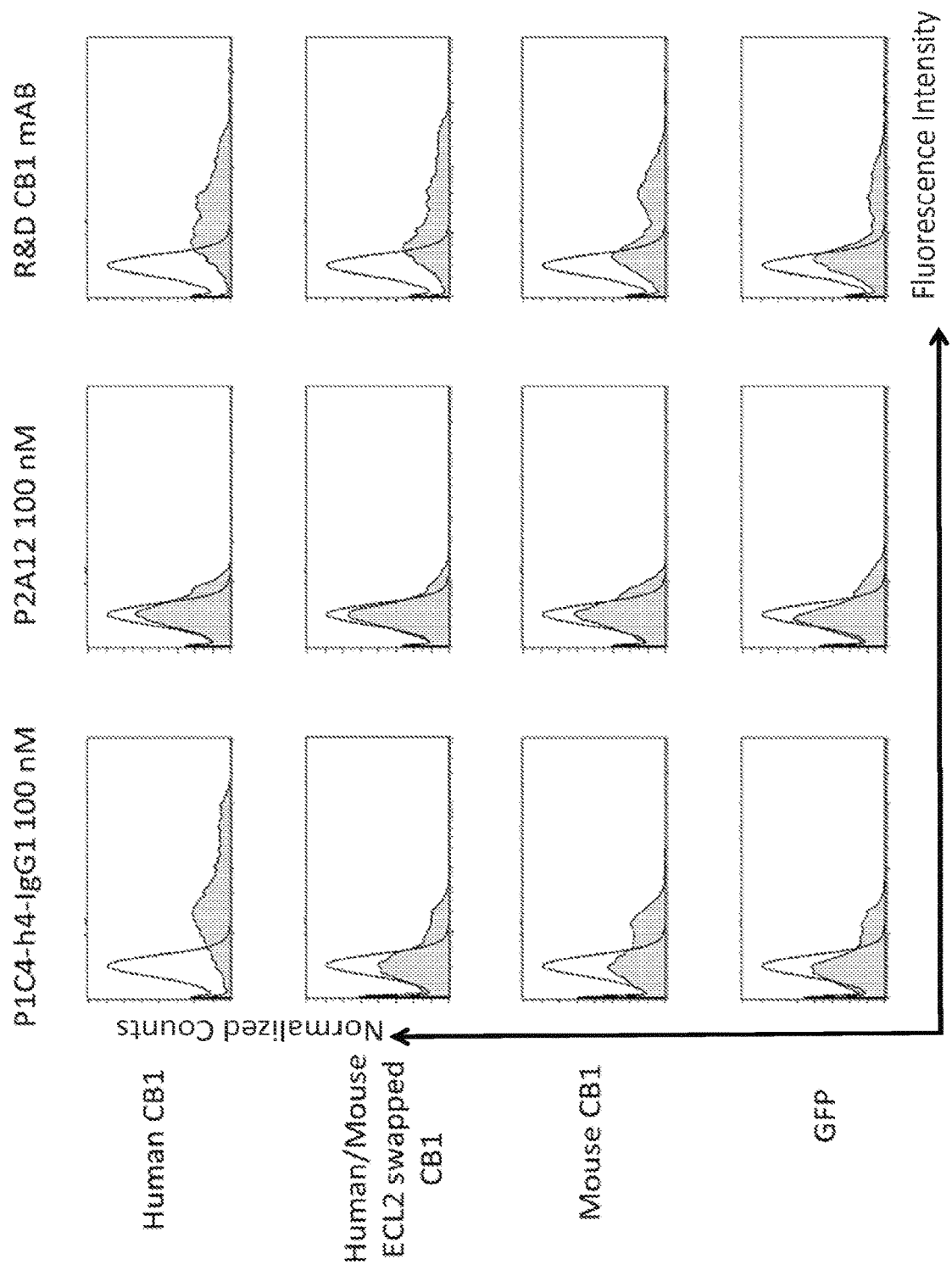
FIG. 21 shows flow cytometry data measuring the binding of antibodies (indicated at top) to cells expressing various CB1 constructs (indicated at left).

As shown in FIG. 21, P1C4-h4-IgG1 bound to human CB1, but not mouse CB1 or human/mouse ECL2 swapped CB1. The only difference between human CB1 and human/mouse ECL2 swapped CB1 are at the ECL2 residues E→K and H→L. The flow cytometry binding results indicated that ECL2 are critical for P1C4 binding. R&D CB1 monoclonal antibody was used as positive control showing the expression of CB1. P2A12 and pcDNA4TO-GFP were used as staining control and empty vector control respectively.

Example 23. ADCC and CDC Effector Function Analysis

To confirm the presumed absence of effector function of humanized P1C4 variants P1C4-h2-IgG2 and P1C4-h2-IgG4 antibody dependent cell mediated cytotoxicity (ADCC) and complement dependent cytotoxicity (CDC) assays were performed using Daudi cells.

For ADCC assay, Daudi target cell concentration was adjusted to 12.5×10$^4$ cells/mL with ADCC medium. 80 μL of cell suspension (1×10$^4$ viable cells) was added to each well of a round-bottom 96-well plate. Twenty μL of antibody, serially diluted in ADCC medium, was dispensed to each well in triplicate. The final concentrations of Rituximab and Anti-hel-hIgG1 were: 0.128 ng/mL, 0.64 ng/mL, 3.2 ng/mL, 16 ng/mL, 80 ng/mL, 0.4 µg/mL, 2 µg/mL; the final concentration of Anti-hel-hIgG2, Anti-hel-hIgG4, P1C4-h2-IgG2 and P1C4-h2-IgG4 were: 3.2 ng/mL, 16 ng/mL, 80 ng/mL, 0.4 µg/mL, 2 µg/mL, 10 µg/mL, 50 µg/mL. The plate was incubated at 22-25° C. for 30 minutes. PBMC concentration was adjusted with ADCC medium so that by adding 1004 of PBMC cells to the target cells, the Effector: Target cell ratio were 25:1 and 50:1, respectively. The plate was centrifuged at 250×g for 4 minutes and then incubated at 37° C. 45 minutes prior to harvesting the supernatant, 20 µL of lysis solution from the CytoTox 96 kit (Promega) was added to maximum lysis control wells. After a 5 hour incubation, the plate was centrifuged at 250×g for 4 minutes. 50 µL of supernatant from each well was transfer to a clean flat-bottom 96 well assay plate. 50 µL of substrate from CytoTox 96 kit (Promega) was added to each well and mixed for 30 seconds. The plate was incubated at room temperature for 30 minutes before 50 µL of stop solution was added to each well and mixed for 30 seconds. The absorbance was read at 490 nm. For data analysis: the % lysis is calculated using GraphPad Prism 5.0 to generate the $IC_{50}$, as follows:

$$\% \text{ Lysis} = \frac{(\text{Experimental release}) - (\text{Target} + PBMC)}{(\text{Max lysis}) - \text{Ave}(\text{Target only})} \times 100\%$$

Figure 22A:
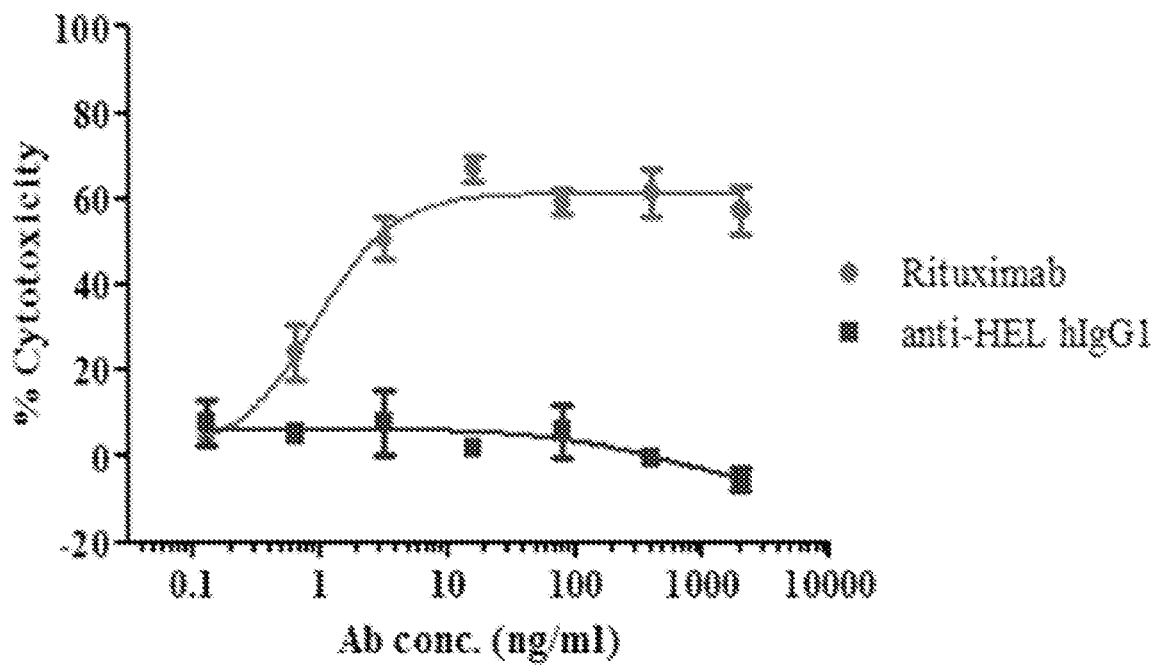
FIGS. 22A-C show the effect of P14C variants in antibody mediated toxicity assays.
Figure 22A:
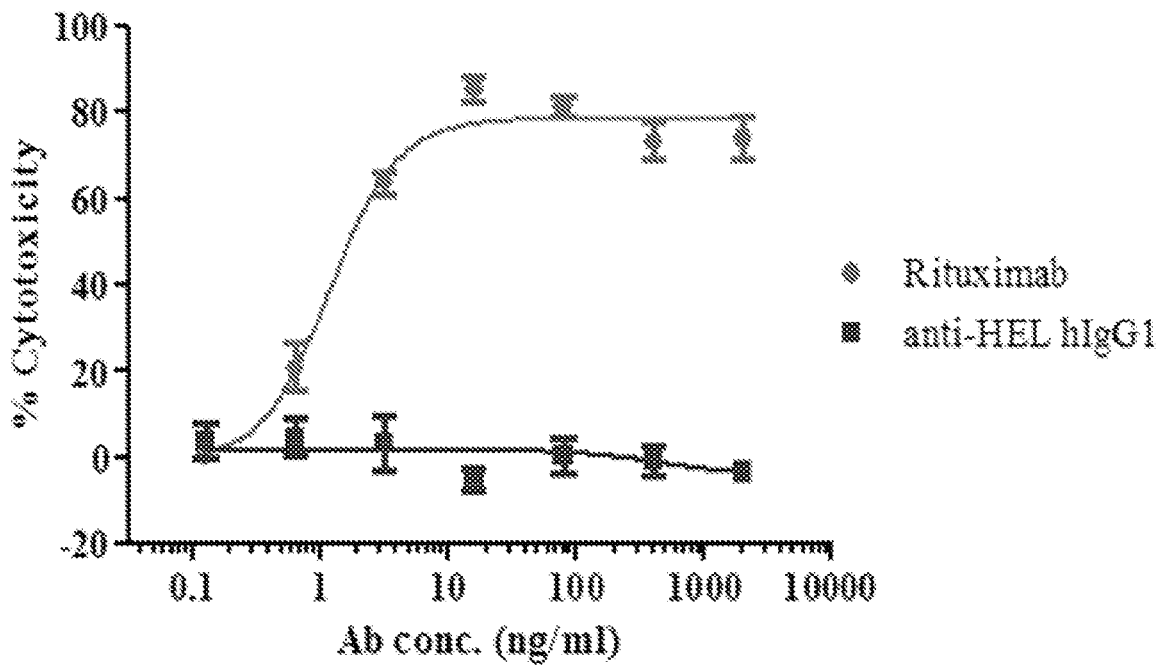
Figure 22B:
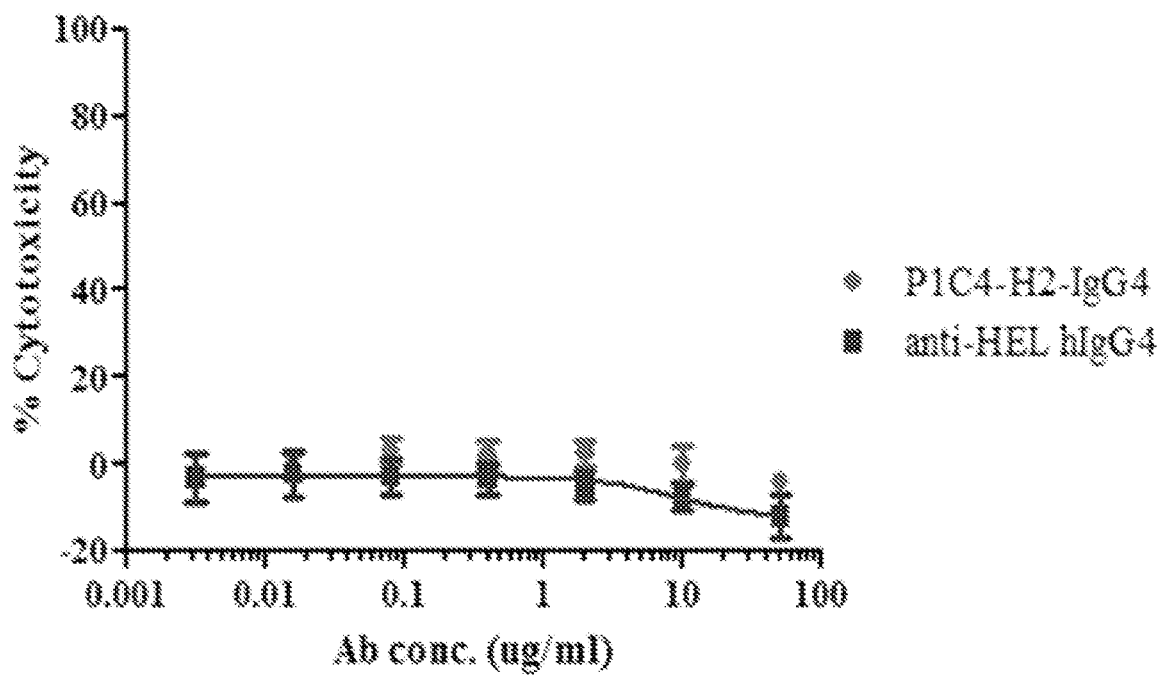
Figure 22B:
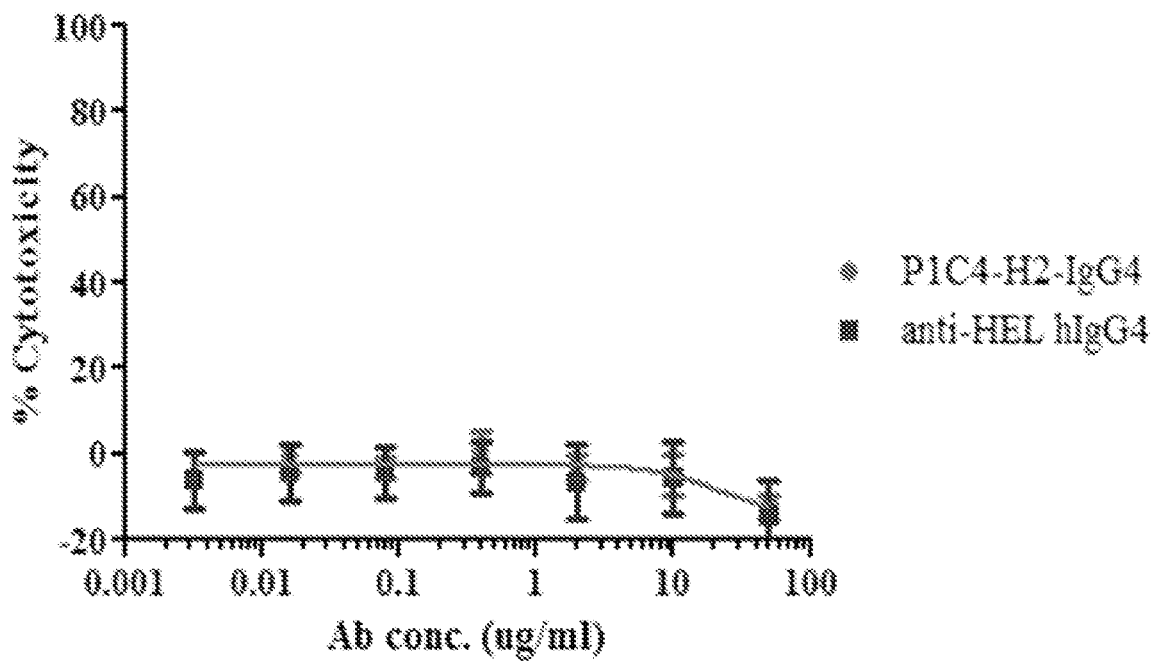
Figure 22C:
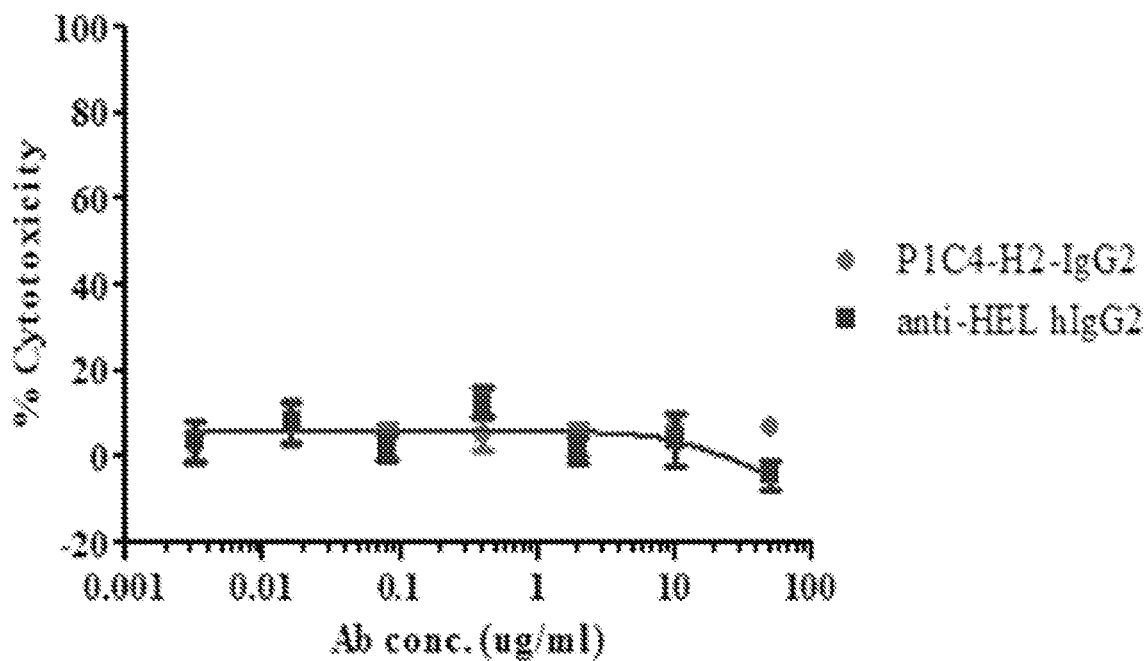
Figure 22C:
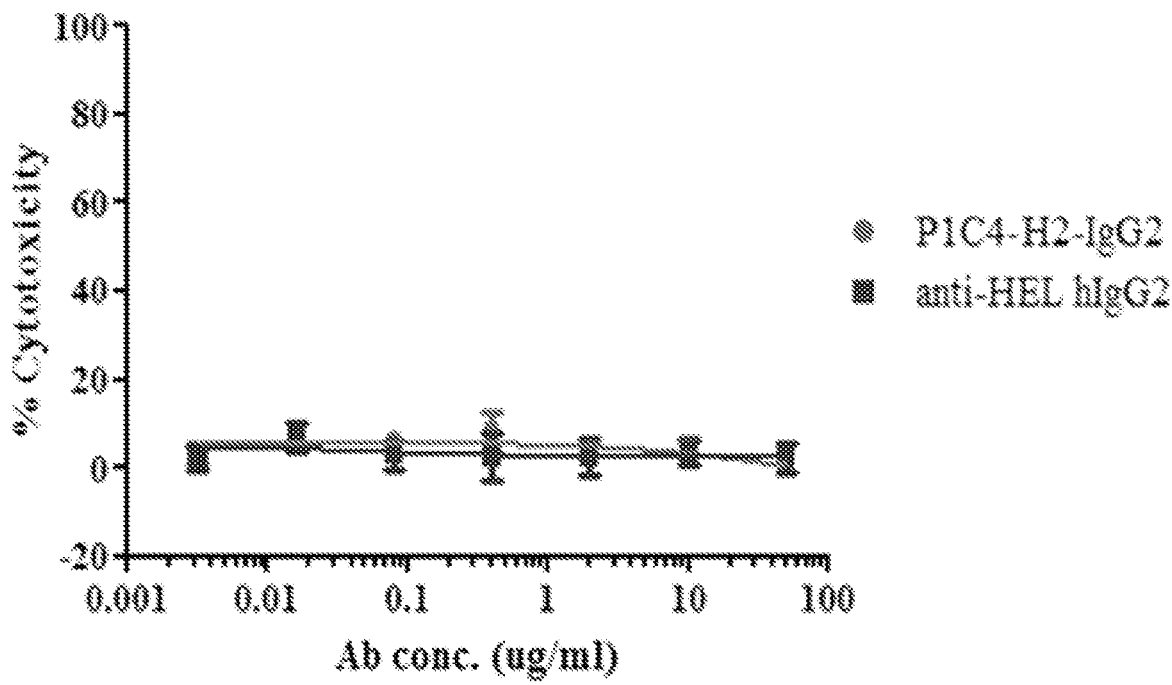

Rituximab induced ADCC effect in Daudi cells with the IC50 of 1.19 ng/mL at 50:1 E/T ratio, of 0.92 ng/mL at 25:1 E/T ratio. As shown in FIG. 22A-C the P1C4 Fc variants antibodies had no ADCC effect at 50:1 and 25:1 E/T ratio in Daudi cells.

For CDC assay Daudi target cells were harvested and cell concentration was adjusted to $80 \times 10^4$ cells/mL with cell culture medium. To a flat-bottom 96-well white plate, 25 µL/well of cells was added. Then, 12.5 µL/well of P1C4, Rituximab, Anti-HEL-hIgG1, and Anti-HEL-hIgG2, serially diluted in ADCC medium, were added to each well in duplicate. The final concentrations of Rituximab and Anti-hel-hIgG1 were: 0.128 ng/mL, 0.64 ng/mL, 3.2 ng/mL, 16 ng/mL, 80 ng/mL, 0.4 µg/mL, 2 µg/mL; the final concentration of Anti-hel-hIgG2, Anti-hel-hIgG4, P1C4-H2-IgG2 and P1C4-H2-IgG4 were: 3.2 ng/mL, 16 ng/mL, 80 ng/mL, 0.4 µg/mL, 2 µg/mL, 10 µg/mL, 50 µg/mL. The plates were incubated in the hood for 15 minutes. Human complement, diluted with ADCC medium, was added to the plates containing cells at 12.5 µL/well to reach a final concentration of 10%. For the maximum lysis wells, 5 µL of lysis solution was added. The final volume of all the wells was adjusted to 50 µL with ADCC medium. The plates were incubated at 37° C. for 2 hours before 50 µL/well of CTG solution was added to the cells. The plates were shaken on a microplate shaker for 2 minutes at a speed of 200 and then incubated at room temperature for 10 minutes. The luminescence signal was red with Envision. For data analysis, % cytotoxicity and $IC_{50}$ was calculated using GraphPad Prism 5.0 as follows:

$$\% \text{ Cytotoxicity} = \frac{\text{Experimental} - \text{Ave (cell} + \text{complement)}}{\text{Ave (Maxi lysis)} - \text{Ave (cell only)}} \times 100\%$$

Figure 22D:
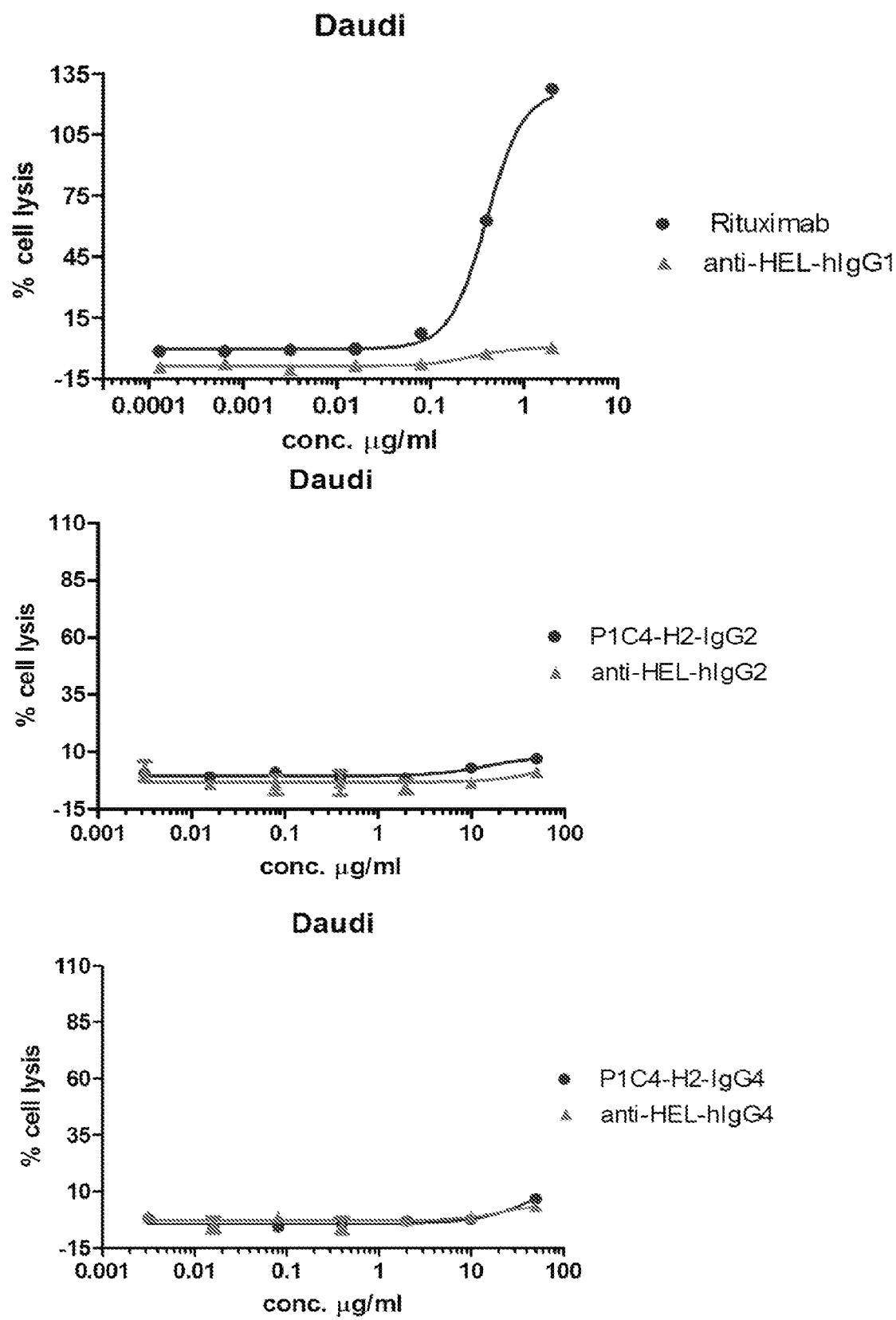
FIG. 22D shows the effect of P14C variants in complement dependent cytotoxicity assays.

The CDC effect of antibodies was tested in Daudi cells, cell lysis of Daudi by PBMC was accessed by cell titer Glo assay, the final concentration of complement was 10%. Rituximab induced CDC effect in Daudi cells with IC50 of 399 ng/mL. As shown in FIG. 22D the P1C4 Fc variants antibodies had no CDC effect in Daudi cells.

Example 24. Recognition of Denatured CB1 Protein by P1C4 Antibodies

A study was performed to examine whether PA13R3-P1C4 and its humanized variant antibodies recognize epitope(s) on denatured CB1 protein (His tagged, N/C-termini truncated CB1) by western blot analysis. Purified human CB1 protein (750 ng per lane) was mixed with SDS reducing buffer containing beta-mercaptoethanol (Double Helix). The denatured CB1 recombinant protein was loaded onto 12% reducing SDS-PAGE gels and protein was separated at 120V for one hour, then electro-transferred to PVDF membranes (pre-soaked in methanol) at 300 mA for 70 minutes. Membranes were blocked with 5% NFDM/PBS-T for one hour at 22° C. followed by immune-blotting with test antibodies (2 µg/mL) in 5% NFDM/PBS-T overnight at 4° C. Commercial mouse anti-His antibody and mouse anti-CB1 antibody (R&D Systems) were used as positive controls, and rabbit anti-CB1 antibody (Cayman), which recognizes a C-terminal region that was deleted from the recombinant CB1 protein used in this study, served as a negative control.

After overnight incubation, membranes were washed with 0.5% Tween-20 PBS (PBS-T) three times at 22° C. Secondary antibodies AP-conjugated anti-human IgG (1:5000) or anti-mouse IgG or anti-rabbit IgG in 5% NFDM/PBS-T were added to respective membranes and incubated for 1 hour at 22° C. Membranes were washed three times with PBS-T each for 5 minutes. After the final wash, signal was developed by incubating with NBT/BCIP substrate solution at 22° C. and the reaction was stopped by washing the membrane under running water.

Figure 23A:
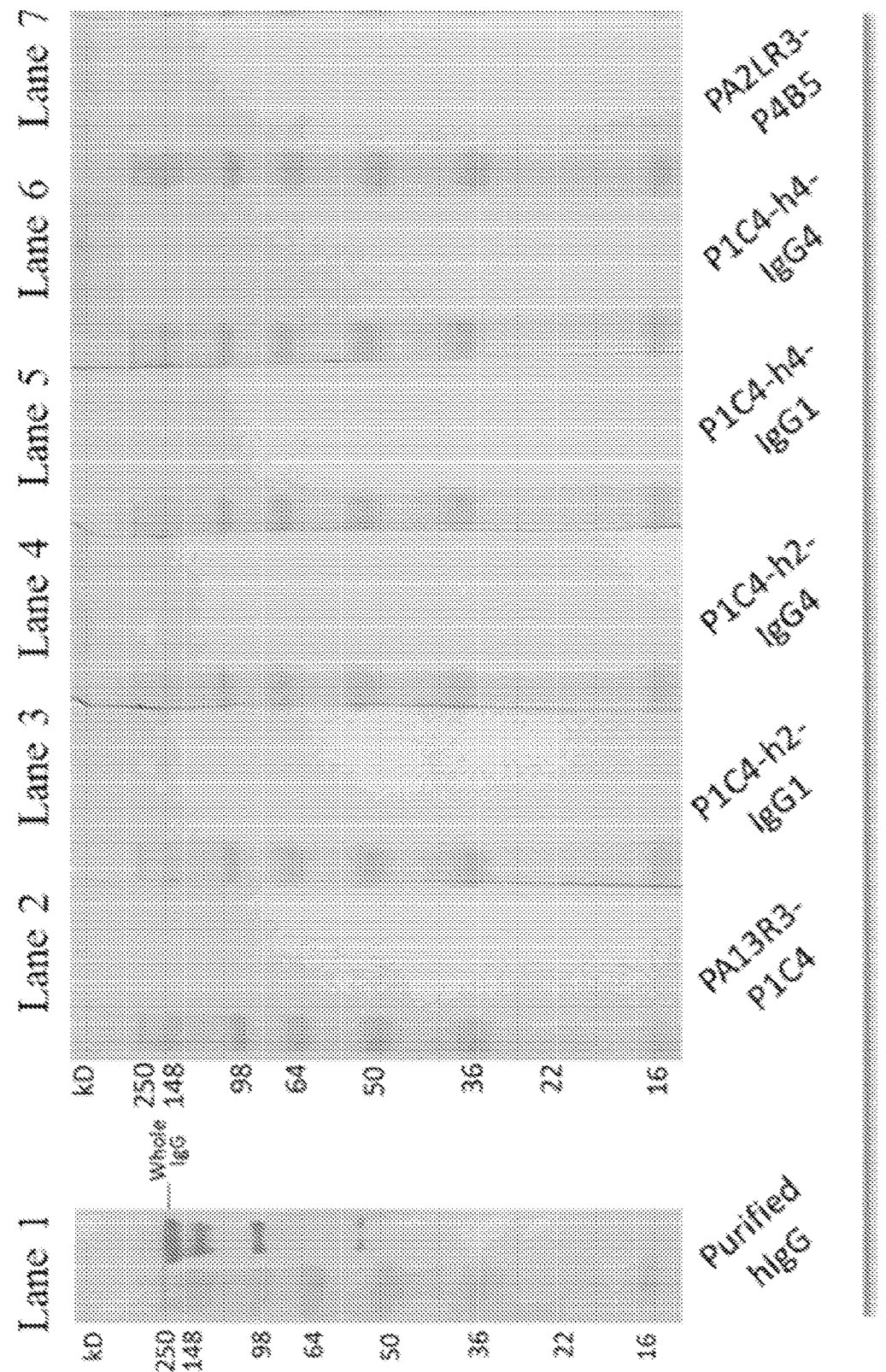
FIG. 23 shows Western Blot analysis assessing recognition of denatured CB1 protein by the indicated P1C4 primary antibodies or control antibodies, and anti-human (FIG. 23A) or anti-mouse (FIG. 23B) secondary antibodies. Purified human IgG with human secondary (FIG. 23A, Lane 1), and mouse primary with anti-rabbit secondary (FIG. 23B, Lane 11) are presented as negative controls.
Figure 23B:
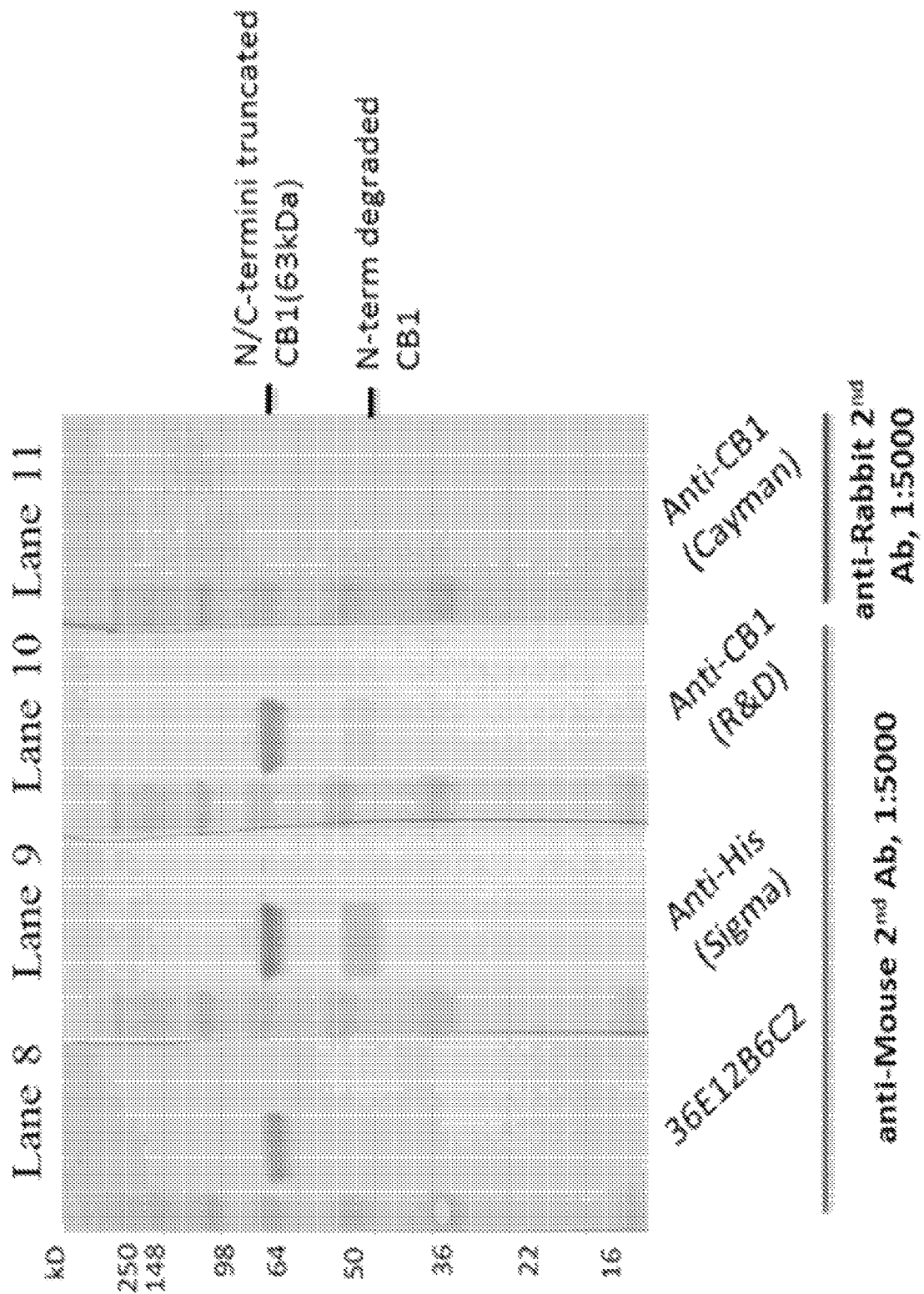

Western blot results showed that positive control antibodies were able to detect denatured CB1 protein with the correct apparent molecular weight of 63 kDa (FIG. 23B, Lanes 9 and 10). No band was detected by the negative control C-terminal specific antibody (FIG. 23B, Lane 11), by PA13R3-P1C4 (FIG. 23A, Lane 2) or by humanized variant antibodies (FIG. 23A, Lanes 3 to 6). Anti-human Fc secondary antibody used in the experiment was able to detect purified human IgG (FIG. 23A, Lane 1). The results indicate that PA13R3-P1C4 and humanized variant antibodies could not recognize denatured and linearized CB1 protein. Together with the flow cytometry experiments, these results confirm that PA13R3-P1C4 and humanized variant antibodies recognize conformational but not linear epitopes.

Example 25. Chimeric and Humanized P1C4 Fab cAMP and FACS Binding

Figure 24:
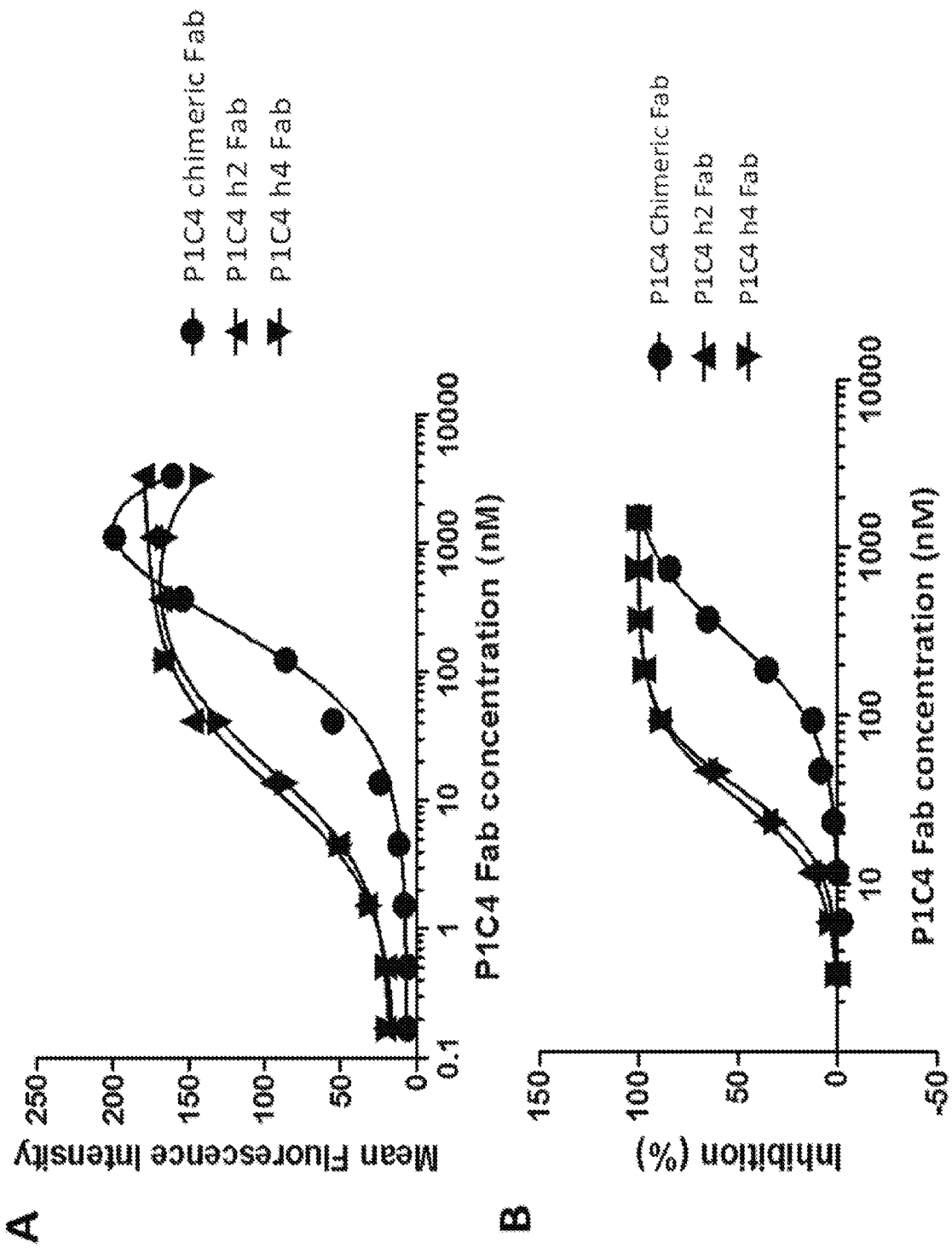
FIG. 24 shows the results of flow cytometry binding experiments (FIG. 24A), and inhibition of cAMP production (FIG. 24B), by chimeric and humanized P1C4 Fab antibody fragments incubated with cells expressing CB1 receptor.

To determine PA13R3-P1C4 Fab binding affinity, full binding curves were generated on CB1 receptor by testing a range of concentrations using TRex-CHO cells stably transfected with tetracycline inducible CB1 expression construct by flow cytometry. Three-fold serial dilutions from 3 µM to 0.1 µM were prepared. FITC-conjugated anti-human antibody was used to detect PA13R3-P1C4 Fab. PA13R3-P1C4 Fab dose dependently bound TRex-CHO CB1 cells (FIG. 24A and Table 17).

A cAMP functional assay was performed to measure the antagonism of P1C4 Fab. The cAMP functional assay (Cisbio) was performed on white 384-well low volume plate (Greiner). 8000 cells/well of stably expressed CB1 TRex CHO cells were seeded to the plate followed by incubating P1C4 Fab at varies concentrations at room temperature for 10 minutes. 5 μM of forskolin (Sigma Aldrich) and 9 nM of the cannabinoid CP55940 (Sigma Aldrich) were added to the cell stimulation mixture to and incubated for 30 minutes at room temperature to activate CB1. After the 30 minutes incubation, 5 μL of cAMP-d2 (1:39 dilution with conjugate and lysis buffer provided by Cisbio) and 5 μL of anti-cAMP cryptate (1:9 dilution with conjugate and lysis buffer provided by Cisbio) were added to the cell stimulation and incubated for an hour. FRET signal was detected with Envision multilabel plate reader (Perkin Elmer) at anti-cAMP cryptate excitation at 620 nm and emission at 665 nm. Data analysis was performed using GraphPad Prism. The results are shown in FIG. 24B and Table 17. The mean±SD of $IC_{50}$s and dissociation constants (Kd) shown were measured from at least 2 different experiments.

TABLE 16

$IC_{50}$ and disassociation constants of PA13R3-P1C4 Fab

| Fab | Cell line | Kd by flow cytometry | $IC_{50}$ cAMP assay |
|---|---|---|---|
| Chimeric P1C4 | Human CB1 | 130 ± 9 nM | 427 ± 121 nM |
| P1C4-h2 | Human CB1 | 14 ± 0.4 nM | 52 ± 22 nM |
| P1C4-h4 | Human CB1 | 16.2 ± 2.3 nM | 43 ± 5 nM |

Example 26. Biophysical Characterization of P1C4 Humanized Variants

We characterize the stability and solubility of PA13R3-P1C4 humanized Fc variants by conducting tests to measure stability under low and high pH and to test maximum solubility. We also characterized the stability of these molecules under accelerated conditions, in human and non-human primate serum, after multiple freeze/thaw cycles and under conditions of pH shift.

In order to characterize the pH stability of the P1C4 humanized variants 200 μL of each antibody (~5 mg/mL) and PBS control were prepared and introduced into a Pur-A-Lyzer Maxi 12000 Dialysis cassette (Sigma, Cat# PURX12015-1KT). Proteins were dialyzed against 2 L of pH 3 buffer (0.1 M acetic acid adjusted to pH 3 by NaOH) or pH 9 buffer (0.2 M glycine adjusted to pH 9 by NaOH) respectively at 4° C. overnight. Protein samples were recovered from dialysis cassettes into pre-weighted empty Eppendorf tubes and checked for visible precipitation. The sample volume was measured by weight. To confirm the success of dialysis, 3 μL of dialyzed sample was taken and checked by pH paper. Fifty μL samples were removed for SEC analysis. The remaining samples were kept in a 40° C. incubator for 48 hours. After that, samples were checked for visible precipitation again. Six μL of 48 hour-incubated sample was injected into TSK G3000SWXL SEC column and the protein concentration calculated by SEC peak area (after 40° C. incubation). To determine protein recovery rate, the following formula was used: Before Dialysis (Vol.×Conc.)/After Dialysis (Vol.×Conc.)×100%.

No precipitation of the 4 IgGs was observed after dialysis to pH 3 and pH 9 buffers followed by a 48 hour incubation at 40° C. For all four IgGs, recovery rates were about 71-83%. Low recovery rate was likely due to sample remaining in dialysis cassette. Monomer IgGs calculated by SEC profile were more than 99% for all 4 dialyzed IgGs. IgGs in pH 3 buffer after a 48 hour incubation at 40° C. showed wider SEC peaks, suggesting higher heterogeneity of IgGs after long incubation at pH 3 buffer. The cAMP and CB1-expressing cell-binding activity was measure according Examples 11 and 7 and the results are summarized in Tables 18 and 19, respectively. The results showed that under pH 3, the cAMP activity of P1C4-h2-IgG4, P1C4-h4-IgG2 and P1C4-h4-IgG4 decreased, as did P1C4-h4-IgG2 under pH 9.

TABLE 18 pH stability of P1C4 humanized variants: solubility

| Sample | pH | Originial Conc. (mg/mL) | Originial Vol (uL) | Conc. (mg/mL) | Recovered Vol (uL) | Recovery rate % | Monomer SEC (%) |
|---|---|---|---|---|---|---|---|
| P1C4-H2-IgG2 | 3 | 4.5 | 200 | 3.79 | 189 | 77.86 | >99 |
| P1C4-H2-IgG4 | 3 | 5.2 | 200 | 4.06 | 184 | 71.83 | >99 |
| P1C4-H4-IgG2 | 3 | 4.6 | 200 | 3.85 | 177 | 74.07 | >99 |
| P1C4-H4-IgG4 | 3 | 5.5 | 200 | 2.99 | 282 | 76.65 | >99 |
| P1C4-H2-IgG2 | 9 | 4.6 | 200 | 4.23 | 176 | 80.92 | >99 |
| P1C4-H2-IgG4 | 9 | 5.2 | 200 | 4.6 | 182 | 80.50 | >99 |
| P1C4-H4-IgG2 | 9 | 4.6 | 200 | 4.26 | 179 | 82.88 | >99 |
| P1C4-H4-IgG4 | 9 | 5.5 | 200 | 4.77 | 188 | 81.52 | >99 |
| P1C4-H2-IgG2 | 3 | 4.6 | 200 | 3.79 | 189 | 77.86 | >99 |
| P1C4-H2-IgG4 | 3 | 5.2 | 200 | 4.06 | 184 | 71.83 | >99 |
| P1C4-H4-IgG2 | 3 | 4.6 | 200 | 3.85 | 177 | 74.07 | >99 |
| P1C4-H4-IgG4 | 3 | 5.5 | 200 | 2.99 | 282 | 76.65 | >99 |
| P1C4-H2-IgG2 | 9 | 4.6 | 200 | 4.23 | 176 | 80.92 | >99 |
| P1C4-H2-IgG4 | 9 | 5.2 | 200 | 4.6 | 182 | 80.50 | >99 |
| P1C4-H4-IgG2 | 9 | 4.6 | 200 | 4.26 | 179 | 82.88 | >99 |
| P1C4-H4-IgG4 | 9 | 5.5 | 200 | 4.77 | 188 | 81.52 | >99 |

TABLE 19 pH stability of P1C4 humanized variants: cAMP activity

| $IC_{50}$ (nM) | h2-IgG2 | h2-IgG4 | h4-IgG2 | h4-IgG4 |
|---|---|---|---|---|
| Mean + SD (Evitra) | 69 ± 16 | 58 ± 5 | 50 ± 17 | 61 ± 23 |
| Acceptable range (50-150%) | 34.5-103.5 | 29-87 | 25-75 | 30.5-91.5 |
| pH 3 | 83 | 104 | 115 | 139 |
| pH 9 | 87 | 85 | 97 | 64 |

The solubility of P1C4 humanized variants was characterized by concentrating 400 μL IgG (~5 mg/mL), by centrifugal filtration (Amicon Ultra-0.5 mL 30K) at 14000×g at 4° C. down to ~100 μL. 200 μL more IgG was added into centrifugal filters and concentrated at 14000×g at 4° C. down to ~100 μL. After that another 200 μL IgG was added into centrifugal filters and concentrate at 14000×g at 4° C. down to ~100 μL (from total 800 μL to 100 μL). The concentrated protein was inspected for visible precipitation by pipetting up and down. The concentration was then continued at 14000×g at 4° C. until the volume was less than 50 μL. The centrifugal filters were reversed and set in pre-weighted empty tube. The centrifuge filters were spun down at 1000×g for 5 minutes at 4° C. to collect the concentrated sample. The tubes were weighed to obtain sample volumes. If precipitation was visible, the tubes were spun down at 14000×g for 10 minutes at 4° C. Supernatants were removed into new 1.5 mL Eppendorf tubes and incubate at room temperature for 24 hours. Afterwards, precipitation was spun down by centrifugation at 14000×g for 10 minutes at 4° C. and supernatants were moved into new 1.5 mL Eppendorf tubes. For SEC characterization, 6 μL supernatant of concentrated sample was injected into TSK G3000SWXL SEC column and the protein concentration calculated by SEC peak area. The protein recovery rate was calculated as: Before Conc. (Vol.×Conc.)/After Conc. (Vol.×Conc.)×100%.

Four Fc variants were concentrated to the protein concentration higher than 85 mg/mL. The protein recovery rates were more than 99%. Slight visible precipitation of P1C4-h2-IgG4 at 93.9 mg/mL before and after 24 hour incubation at room temperature was observed. No visible precipitation for other 3 IgGs at concentration higher than 85 mg/mL after 24 hour incubation at room temperature was observed. Monomer IgGs calculated by SEC profile are more than 96% for all 4 concentrated IgGs compared to the starting level at ~99%. The data are summarized in Table 20.

TABLE 20

Solubility of P1C4 humanized variants

| Sample | Originial Conc. (mg/mL) | Originial Vol (uL) | Conc. (mg/mL) | Conc. Vol (uL) | Recovery rate % | Monomer SEC (%) |
| --- | --- | --- | --- | --- | --- | --- |
| P1C4-H2-IgG2 | 4.6 | 800 | 85.6 | 43.6 | >99 | 96.84 |
| P1C4-H2-IgG4 | 5.2 | 800 | 93.9 | 44.5 | >99 | 97.39 |
| P1C4-H4-IgG2 | 4.6 | 800 | 87.84 | 42.2 | >99 | 97.05 |
| P1C4-H4-IgG4 | 5.5 | 800 | 116.51 | 38.7 | >99 | 96.38 |

The accelerated stability of P1C4 humanized variants was also assessed. In a 1.5 mL Eppendorf tube, 100 μL protein sample (~5 mg/ml) was placed. The tube was sealed with Parafilm. Two tubes were set up, one was kept at 4° C. and the other was kept at 40° C. for 33 days. An aliquot of 20 μl was removed to check visible precipitation and for SEC analysis. For SEC analysis, 6 μL sample was injected into TSK G3000SWXL SEC column and the protein concentration was measured by SEC peak area. The protein recovery rate was calculated as following: Before Incubation (Vol.× Conc.)/After Incubation (Vol. Conc.)×100%.

No precipitation was observed after a 33 day incubation at 4° C. and 40° C. Monomer IgGs calculated by SEC profile were more than 98% for all 4 IgGs at both 4° C. and 40° C. The recovery rate calculated by SEC profile was more than 96% for all 4 IgGs at both 4° C. and 40° C. (Table 21). No change in potency of P1C4 Fc variant was observed after 33 days at 4° C. and 40° C., except P1C4-h4-IgG2, which showed $IC_{50}$ outside of the referenced range indicating there is a slight reduce in its potency. (Table 22).

TABLE 21

Accelerated stability: Solubility

| Sample | Temp (C.) | Incubation days | Originial Conc. (mg/mL) | Conc. (mg/mL) | Recovery rate % | Monomer SEC (%) |
| --- | --- | --- | --- | --- | --- | --- |
| P1C4-H2-IgG2 | 4 | 33 | 4.6 | 4.66 | >99 | >99 |
| P1C4-H2-IgG4 | 4 | 33 | 5.2 | 5.23 | >99 | >99 |
| P1C4-H4-IgG2 | 4 | 33 | 4.6 | 4.71 | >99 | >99 |
| P1C4-H4-IgG4 | 4 | 33 | 5.5 | 5.47 | >99 | >99 |
| P1C4-H2-IgG2 | 40 | 33 | 4.6 | 4.66 | >99 | >99 |
| P1C4-H2-IgG4 | 40 | 33 | 5.2 | 5.28 | >99 | 98 |
| P1C4-H4-IgG2 | 40 | 33 | 4.6 | 4.46 | 96.96 | >99 |
| P1C4-H4-IgG4 | 40 | 33 | 5.5 | 5.28 | 96.00 | >99 |

TABLE 22

Accelerated stability: Potency

| $IC_{50}$ (nM) | h2-IgG2 | h2-IgG4 | h4-IgG2 | h4-IgG4 |
| --- | --- | --- | --- | --- |
| Mean + SD (Evitra) | 69 ± 16 | 58 ± 5 | 50 ± 17 | 61 ± 23 |
| Acceptable range (50-150%) | 34.5-103.5 | 29-87 | 25-75 | 30.5-91.5 |
| At 4° C. for 33 days | 75 | 55 | 69 | 62 |
| At 40° C. for 33 days | 65 | 68 | 88 | 71 |

Serum stability of P1C4 humanized variants was also characterized. Human serum was obtained from Sigma. Non-Human Primate serum was collected by Crown Bioscience. In an Eppendorf tube, 950 μL serum was mixed with 50 μL IgG at final conc. 250 μg/ml (~1.67 μM) and incubate at 37° C. Samples of 200 μL were taken at time points 0, 24, 48, and 72 hours for flow cytometry binding assay using CB1-expressing cells. The starting concentration for IgG tested was 500 nM and the samples were serial diluted 3 fold for flow cytometry assays to determine binding $K_D$. The results, listed in Table 23 and 24, showed no changes in affinity after 24 hours incubation with human or NHP serum at 37° C. No significant change in $K_D$ was observed for the samples except P1C4-h2-IgG2, which showed a decrease of CB1-expressing cell-binding affinity after 48 hours incubation with human and NHP sera. In addition, P1C4-h4-IgG2 also showed reduced CB1-expressing cell-binding affinity after 48 hours.

TABLE 23

Human serum stability of P1C4 humanized variants, 24 hours

| $K_d$ (nM) in human sera | h2-IgG2 | h2-IgG4 | h4-IgG2 | h4-IgG4 |
|---|---|---|---|---|
| Mean + SD (Evitra) | 69 ± 16 | 58 ± 5 | 50 ± 17 | 61 ± 23 |
| Acceptable range (50-150%) | 14.5-43.5 | 17-51 | 15.5-46.5 | 15-45 |
| 0 hours | 21 | 16 | 23 | 16 |
| 24 hours | 21 | 11 | 17 | 12 |
| 48 hours | 56 | 19 | 31 | 12 |
| 72 hours | 38 | 20 | 11 | 15 |

TABLE 24

NHP serum stability of P1C4 humanized variants

| Kd (nM) in NHP sera | h2-IgG2 | h2-IgG4 | h4-IgG2 | h4-IgG4 |
|---|---|---|---|---|
| Mean + SD (Evitra) | 69 ± 16 | 58 ± 5 | 50 ± 17 | 61 ± 23 |
| Acceptable range (50-150%) | 14.5-43.5 | 17-51 | 15.5-46.5 | 15-45 |
| 0 hours | 21 | 19 | 20 | 20 |
| 24 hours | 15 | 12 | 16 | 13 |
| 48 hours | 57 | 37 | 48 | 28 |
| 72 hours | 41 | 29 | 33 | 26 |

The freeze/thaw stability of P1C4 humanized variants was characterized as follows. A 100 μL aliquot from frozen stocks of each humanized P1C4 Fc variants was thawed in a 22° C. water bath, then rapid frozen by liquid nitrogen. The frozen sample was kept at −80° C. for at least 20 minutes before it was thawed in a 22° C. water bath again. The samples went through 10 such freeze/thaw cycles. Visual inspection was used to check for precipitation. A 20 μL aliquot was removed from the sample for SEC analysis at freeze/thaw cycle 1, 5, and 10. For SEC characterization, 6 μL of incubated sample was injected into TSK G3000SWXL SEC column. The protein concentration was measured by SEC peak area. The protein recovery rate was calculated by using formula: Before F/T (Conc.)/After F/T (Conc.)×100%.

The results showed that after 10 freeze/thaw cycles monomer IgGs were higher than 97% for all 4 IgG variants tested. The protein recovery rate was more than 96% for all IgGs. P1C4-H2-IG4 showed slight turbidity after 1st freeze thaw cycle, but no significant precipitation or decrease of protein concentration was observed. The results are summarized in Tables 25-28. The protein samples recovered after 5 freeze/thaw cycles were also tested for function using the cAMP antagonist assay, and the calculated $IC_{50}$ results showed no significant changes in potency with the numbers falling within the normal range (Table 29).

TABLE 25

Freeze/thaw stability of P1C4-H2-IgG2

| Sample | F/T Cycles | Originial Conc. (mg/mL) | Conc. (mg/mL) | Recovery rate % | Monomer SEC (%) |
|---|---|---|---|---|---|
| P1C4-H2-IgG2 | 0 | 4.6 | 4.60 | >99 | >99 |
| P1C4-H2-IgG2 | 1 | 4.6 | 4.66 | >99 | >99 |
| P1C4-H2-IgG2 | 5 | 4.6 | 4.57 | >99 | >99 |
| P1C4-H2-IgG2 | 10 | 4.6 | 4.58 | >99 | >99 |

TABLE 26

Freeze/thaw stability of P1C4-H2-IgG4

| Sample | F/T Cycles | Originial Conc. (mg/mL) | Conc. (mg/mL) | Recovery rate % | Monomer SEC (%) |
|---|---|---|---|---|---|
| P1C4-H2-IgG4 | 0 | 5.2 | 5.20 | >99 | >99 |
| P1C4-H2-IgG4 | 1 | 5.2 | 5.21 | >99 | >99 |
| P1C4-H2-IgG4 | 5 | 5.2 | 5.18 | >99 | 98.49 |
| P1C4-H2-IgG4 | 10 | 5.2 | 5.01 | 96.41 | 97.88 |

TABLE 27

Freeze/thaw stability of P1C4-H4-IgG2

| Sample | F/T Cycles | Originial Conc. (mg/mL) | Conc. (mg/mL) | Recovery rate % | Monomer SEC (%) |
|---|---|---|---|---|---|
| P1C4-H4-IgG2 | 0 | 4.6 | 4.60 | >99 | >99 |
| P1C4-H4-IgG2 | 1 | 4.6 | 4.60 | >99 | >99 |
| P1C4-H4-IgG2 | 5 | 4.6 | 4.58 | >99 | >99 |
| P1C4-H4-IgG2 | 10 | 4.6 | 4.52 | 98.35 | >99 |

TABLE 28

Freeze/thaw stability of P1C4-H4-IgG4

| Sample | F/T Cycles | Originial Conc. (mg/mL) | Conc. (mg/mL) | Recovery rate % | Monomer SEC (%) |
|---|---|---|---|---|---|
| P1C4-H4-IgG4 | 0 | 5.5 | 5.50 | >99 | >99 |
| P1C4-H4-IgG4 | 1 | 5.5 | 5.46 | >99 | >99 |
| P1C4-H4-IgG4 | 5 | 5.5 | 5.53 | >99 | 98.60 |
| P1C4-H4-IgG4 | 10 | 5.5 | 5.37 | 97.64 | 98.05 |

TABLE 29

Freeze/thaw stability of humanized variants: cAMP activity after 5 cycles

| IC50 (nM) | h2-IgG2 | h2-IgG4 | h4-IgG2 | h4-IgG4 |
|---|---|---|---|---|
| Mean + SD (Evitra) | 69 ± 16 | 58 ± 5 | 50 ± 17 | 61 ± 23 |
| Acceptable range (50-150%) | 34.5-103.5 | 29-87 | 25-75 | 30.5-91.5 |
| 5 F/T cycles | 38 | 28 | 43 | 32 |

To examine stability of 4 P1C4 Fc variants under pH shift, 0.2 mL MabSelect resin was packed into 10 mL column and equilibrated with 10 mL DPBS pH 7.4. 150 μL IgG sample (~5 mg/mL) was loaded onto column. The column was washed with 1.6 mL DPBS. The IgG was then eluted with 1.6 mL sodium citrate (pH ~3.5). The concentration of the protein was measured. The protein was then concentrated to ~3 mg/mL for functional assay. No visible precipitation was observed. These samples were spun down at 14000×g for 10 minutes at 4° C. The supernatant was transferred to a new eppendorf tube and the protein concentration was measured. This sample was also checked for aggregation by SEC and functionally tested by cAMP antagonist assay. The SEC profiles showed that monomer IgG percentage is more than 95% after the pH is shifted to pH 3.5. The cAMP antagonist results are listed in Table 30 and showed that P1C4-h2-IgG4, P1C4-h4-IgG2 and P1C4-h4-IgG4 were stable at pH 3.5, with the $IC_{50}$s measured falling within the acceptable range. P1C4-h2-IgG2 behaved differently at pH 3.5, with a lower $IC_{50}$ value compared to the acceptable range. This result is similar to that in the pH stability test.

TABLE 30

Stability of P1C4 humanized variants under pH shift

| IC50 (nM) | P1C4-h2-IgG2 | P1C4-h2-IgG4 | P1C4-h4-IgG2 | P1C4-h4-IgG4 |
|---|---|---|---|---|
| Mean + SD (Evitra) | 69 ± 16 | 58 ± 5 | 50 ± 17 | 61 ± 23 |
| Acceptable range | 34.5-103.5 | 29-87 | 25-75 | 30.5-91.5 |
| pH 3.5 | 34 | 59 | 55 | 43.4 |

Example 27. CDR Mutagenesis of PA13R3-P1C4

To investigate the role of each amino acid position on each CDR, site-directed saturation mutagenesis was conducted on every CDR position of chimeric P1C4 Fab. Mutagenic primers containing NNS or a specific codon were synthesized, dissolved in Tris-EDTA buffer and diluted to 10 µM working stock. Twenty five µL PCR reactions were set up in 96-well plates using high fidelity DNA polymerase. The resulting PCR products were treated with 0.8 µL DpnI (20 U/4) in each well 37° C. for 5 hours. The DpnI-treated PCR product (2 µL) was transformed into 30 µl E. coli Dh5α competent cells. DNA was isolated from the transformants by miniprep and sequenced to identify desired mutations. Plasmid DNA from desired clones was used to transform E. coli BL21 (CodonPlus) competent cells. Single colonies were used for Fab protein expression.

For Fab expression, colonies were picked into 96-well plate containing 100 µl SB medium and cultured overnight. On the next day, 10 µL from each well was used to inoculate 500 µL ZYM medium with 50 µg/mL Kanamycin in deep well 96 well plate. The plate was sealed with breathable plate sealer and shaken 36 hours at 25° C. in shaker at 450 rpm.

To prepare samples for ELISA, the deep well 96-well plate was centrifuged at 3000 rpm in the Beckman table-top for 20 minutes (~2050 rcf) at 4° C. 100 µL supernatant was transferred from the expression plate into a dilution plate containing 200 µL PBS, pH 7.4 and mixed well.

Fab expression was measured by ELISA. 96-well half-well ELISA plates (Corning, 3690) were directly coated with 2 µg/mL anti-his antibody (Sigma H1029 2 mg/ml) at 50 µl/well overnight at 4° C. The plate was then washed 6 times with 150 µL PBST. Each well was then blocked with 175 µL/well of 3% milk/PBS, pH 7.4 for 1 hour at 22° C. The plate was then washed 6 times with PBST before 25 µL/well Fab containing-culture medium diluted 3 times in PBS, pH 7.4 was added to each well and incubated for 1 hour at 22° C. The plate was again washed 6 times with PBST before 50 µl/well of HRP labeled anti-human Fab antibody (0293 Sigma) was added at 1:10000 dilution in 3% milk and incubated at 22° C. for 1 hour. To develop the ELISA the plate was washed 6 times with PBST and 50 µL/well of TMB substrate were added. The reaction was stopped by adding 50 µL/well 1 N HCl and the $OD_{450}$ was read on the BioTek reader.

For ELISA measuring iCAPS-binding, 96-well half-well ELISA plates were coated with 2 µg/mL, 25 µL/well of streptavidin in PBS, pH 7.4 overnight at 4° C. The plate was then washed 6 times with 150 µL PBST with rotation in between. Then 25 µL/well of 5 ug/mL CB1 iCAPS was added to the plate for 1 hour incubation. After washing 6 times with PBST, each well was blocked with 175 µL/well of 3% milk/PBS pH 7.4 for 1 hour at 22° C. The plate was then washed 6 times with PBST before 25 µL/well Fab containing-culture medium diluted 3 times by PBS pH 7.4 was added to each well and incubated for 1 hour at 22° C. The plate was again washed 6 times with PBST before 50 µl/well anti-human Fab antibody (0293 Sigma) was added at 1:10000 dilution by 3% milk and incubated at 22° C. for 1 hour. To develop the plate, the plate was washed 6 times with PBST, and 50 µL/well of TMB substrate were added. The reaction was stopped by adding 50 µL/well 1 N HCl and the $OD_{450}$ was read on the BioTek reader.

Each clone was assayed in triplicate. To calculate the relative binding to iCAPS normalized by Fab expression, the ELISA signal for iCAPS binding was divided by Fab expression ELISA data, and compared to the data from parental clone. Allowable changes were defined as clones that retained at least 50% specific iCAPS binding activity compared to the parental clones. These allowable changes are summarized in Table 31 and Table 32. The CDR sequences of the indicated mutations can be found in Table 34.

TABLE 31

Allowable mutations PA13R3-P1C4 Heavy Chain CDRs

| CDR | Position | Allowable change (s) |
|---|---|---|
| HCDR1 | Y1 | H, W |
| | Y2 | F, I, K, N |
| | W3 | A, F |
| | M4 | A, E, F, L, N, Q, T, V |
| | N5 | I, K, L, S, W |
| HCDR2 | Q1 | D, E |
| | I2 | A, D, E, F, G, H, K, L, N, Q, R, S, T, W, Y |
| | Y3 | F |
| | P4 | A, F, H, K |
| | G5 | A, C, D, E, F, H, I, K, L, M, Q, R, S, T, V, W, Y |
| | D6 | I, L, M, N, P, Q, V, W, Y |
| | G7 | A, D, E, F, H, I, K, L, M, N, P, Q, R, S, T, V, Y |
| | E8 | A, D, M, Q, V, Y |
| | T9 | A, D, E, F, G, H, I, K, Q, R, S, T, W, Y |
| | K10 | D, E, H, I, L, M, N, P, Q, R, S, T, V, W, Y |
| | Y11 | C, D, E, F, G, H, I, L, N, P, Q, R, T, W |
| HCDR3 | S1 | N, T, Y |
| | Y5 | A, C, F, H, N, S |
| | L6 | D, E, F, G, H, I, K, M, N, Q, S, W, Y |
| | P7 | A, E, F, G, H, KL, Q, R, S, V, W, Y |
| | Y8 | A, D, E, F, G, H, I, K, L, M, R, S, V |

TABLE 32

Allowable mutations PA13R3-P1C4 Light Chain CDRs

| CDR | Position | Allowable change (s) |
|---|---|---|
| LCDR1 | S1 | A, D, F, L, M, R, T, V, W, Y |
| | S2 | A, D, E, F, G, H, K, M, N, P, Q, V, W |
| | Y3 | F |
| | L4 | F, H, I, K, N, P, Q, R, S, T, W, Y |
| LCDR2 | S1 | A, H, N, R |
| | T2 | A, D, F, G, H, L, M, S, V, W, Y |

TABLE 32-continued

Allowable mutations PA13R3-P1C4 Light Chain CDRs

| CDR | Position | Allowable change (s) |
|---|---|---|
|  | S3 | D, F, H, I, K, LN, Q, Y |
|  | N4 | D, E, F, G, H, I, K, Q, R, S, V |
|  | L5 | D, E, F, G, H, I, K, M, N, P, Q, V, W, Y |
|  | A6 | D, F, G, I, K, Q, R, S, V, W |
|  | S7 | A, D, F, G, H, K, L, R, T, V, W |
|  | G8 | A, F, I, N, P, R, S, T, V, Y |
| LCDR3 | H1 | A, C, D, E, F, I, K, L, N, R, S, T, V, W, Y |
|  | Q2 | A, C, E, G, N, S, T, V |
|  | Y3 | A, F, G, H, Q, W |
|  | H4 | A, E, G, K, L, N, Q, S, T, V, W |
|  | R5 | A, C, D, E, F, I, L, M, N, Q, V, W, Y |
|  | S6 | A, C, E, F, G, I, M, P, R, T, V, W, Y |
|  | P7 | K, W, Y |
|  | P8 | D, H |
|  | T9 | D, F, G, I, L, M, N, Q, R, S, V, Y |

Example 28. Immuno-Staining of CB1 in Liver Tissue Samples by P1C4-h2-IgG4 Antibody Conjugated to HRP P1C4-h2-IgG4 antibody was labelled with the Lightning-Link HRP conjugation kit from (Innova Bioscience, 701-0010) according to the manufacturer's instructions. Slides of Parafilm treated human liver samples were treated with Clearene Solvent (Leica Biosystems) for 5 minutes and then with decreasing concentration ethanol to a final 50% concentration. The slides were then placed into methanol/hydrogen peroxide for 15 minutes after which they were briefly washed in PBS. Slides were then treated with citric saline (Vector, H-3300) with heating for antigen retrieval before being placed in pre-warmed of PBS (350 ml) and Trypsin (2.45 ml) in a 37° C. water bath for 20 minutes. After washing with PBS, the slides were blocked with casein (Vector, SP-5020) for 1 hour at room temperature. After blocking 1:100 diluted HRP conjugated P1C4-h2-IgG4 or isotype control antibody was added and incubated overnight at 4° C. The slides were then washed with PBS, and treated with 3 drops of Vector ABC Tertiary (Vector, PK-7100) at 22° C. for 45 minutes. PBS was used to wash the slides for 3 times and DAB mix (Vector, SK-4100) was added to the slides for 5-10 minutes before they were again washed briefly with PBS. Following this, the slides were counter stained with Meyers Haematoxylin (TCS Biosciences, HS315) for 1 minute followed by treatment in water, increasing concentration of ethanol (50% to 100%), 2 rounds of Clearene Solvent before they were mounted in Pertex (Leica Biosystems).

Figure 25:
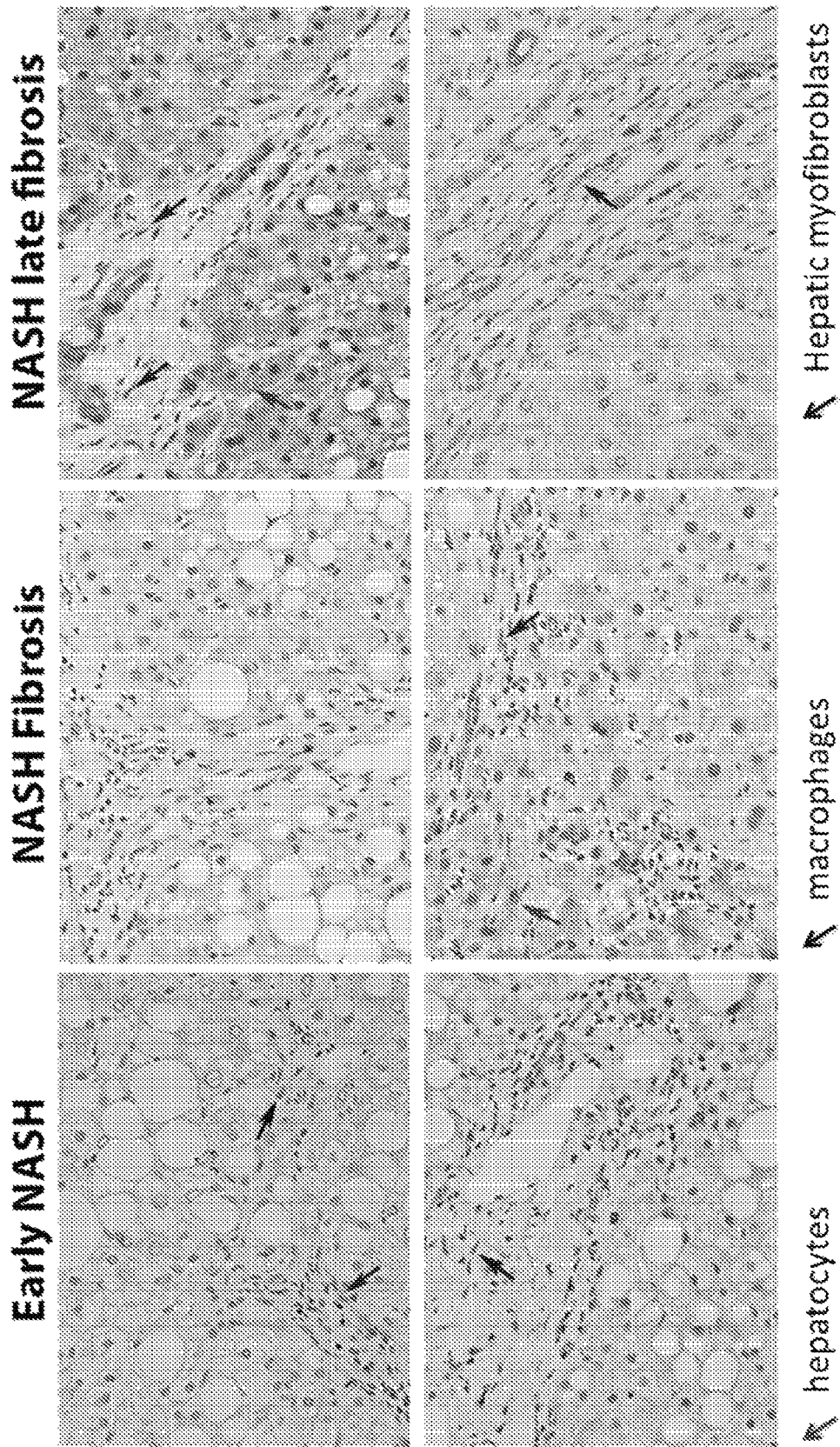
FIG. 25 shows positive CB1-specific staining in macrophage, hepatocytes, and hepatic myofibroblasts in early NASH (left panel), NASH fibrosis (middle panel) and late fibrosis (right panel) samples.
Figure 26:
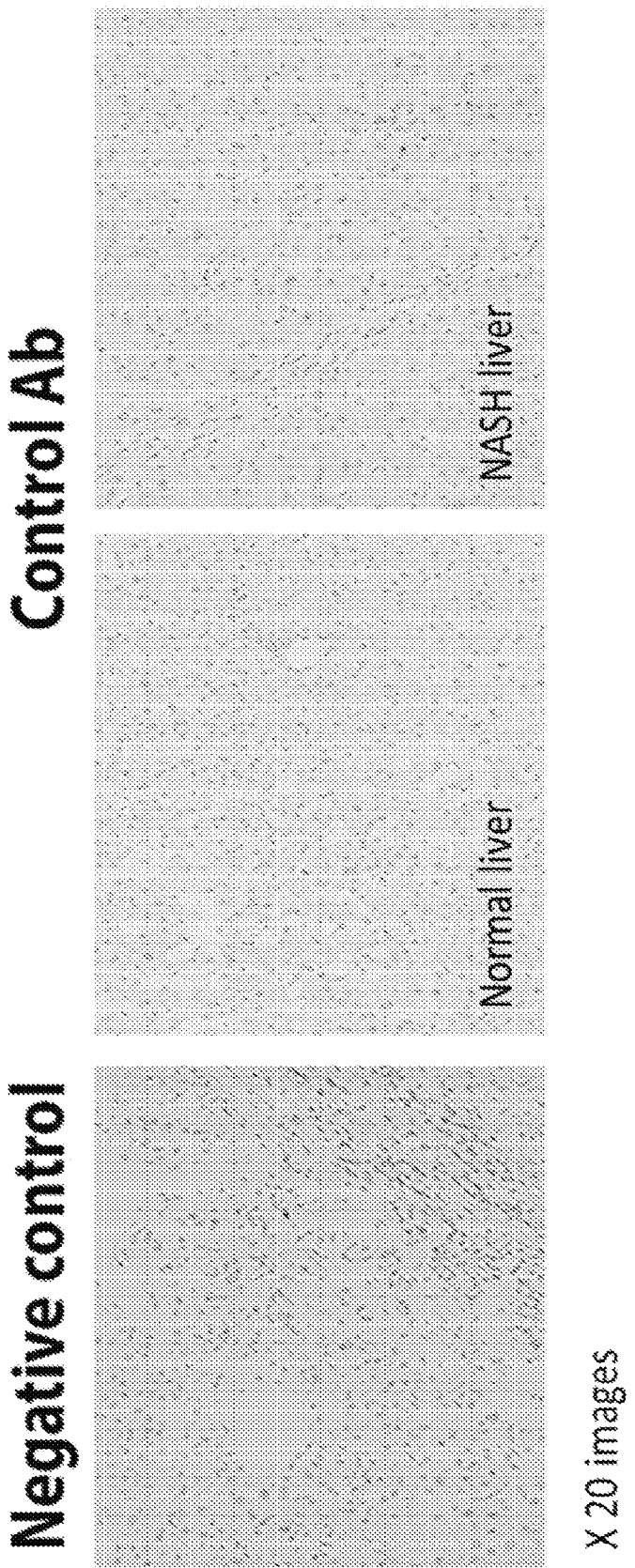
FIG. 26 shows that no staining was observed with isotype controlled irrelevant antibodies in cells derived from either normal (middle panel) or NASH fibrosis (right panel) cells.
Figure 27:
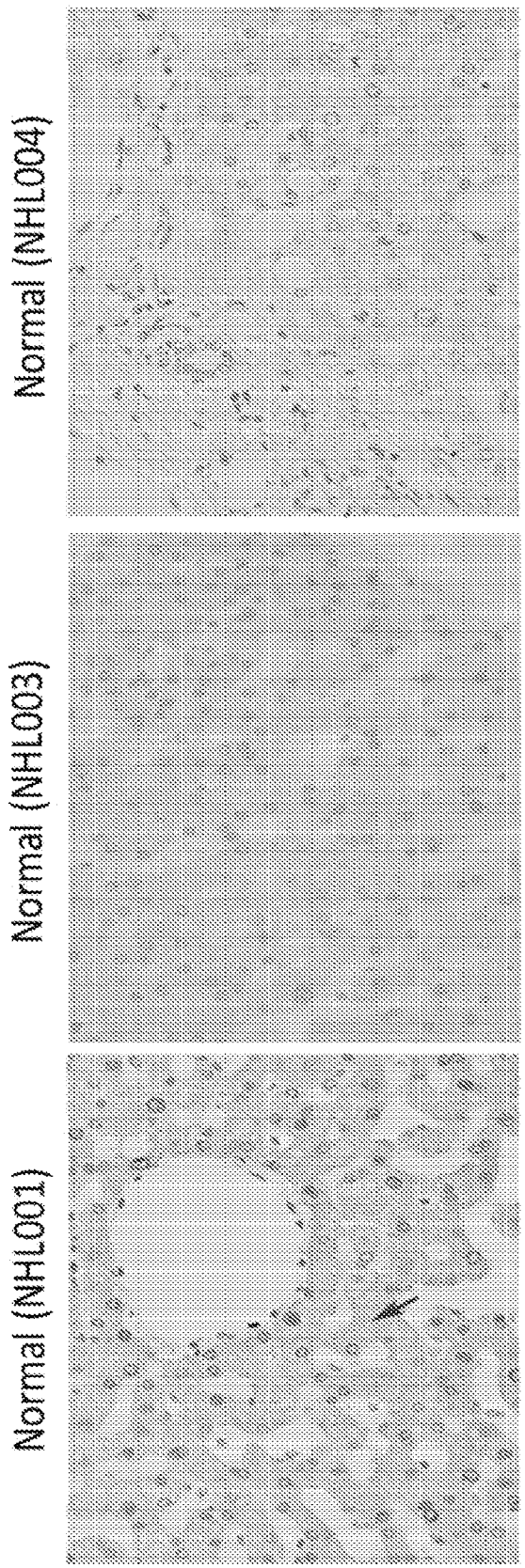
FIG. 27 shows no CB1 specific staining in normal tissues.

The results showed positive CB1-specific staining in macrophage, hepatocytes, and hepatic myofibroblasts in early NASH (FIG. 25, left panel), NASH fibrosis (FIG. 25, middle panel) and late fibrosis (FIG. 25, right panel) samples. No staining was observed with isotype controlled irrelevant antibodies (FIG. 26) or normal tissue samples (FIG. 27).

Example 29. Measuring Effects of Anti-CB1 Antibody on Genetic Markers of Fibrosis in Primary Human Hepatic Stellate Cells Primary hepatic stellate cells (HSCs) were isolated from liver tissue obtained from 3 healthy donors. After 2-3 passages in DMEM+10% FBS, the cells were activated on plastic and placed in medium with 0.5% serum overnight. The cells were then treated for 6 or 24 hours with rimonabant (a CB1 antagonist), P1C4-h2-IgG4 and non-functional control antibodies at various concentrations. Inhibition of pro-fibrotic gene signatures, including α-SMA, Pro-collagen A1(I), TIMP1, and TGFβ, were measured by RT-PCR, and the data were plotted.

Figure 28:
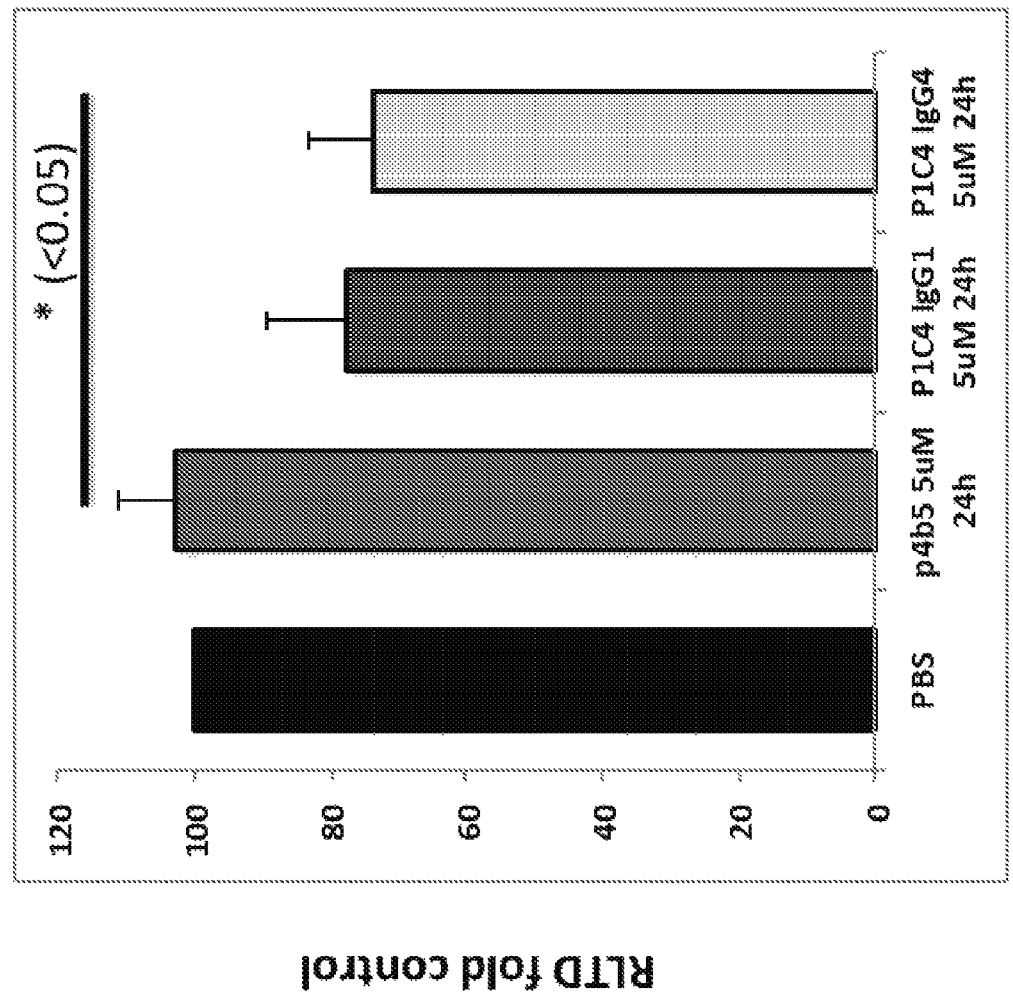
FIG. 28 shows RT-PCR expression data measuring Procollagen A1(I), in primary hepatic stellate cells treated with PBS, non-functional control antibody, and P1C4-h2 antibodies.
Figure 29:
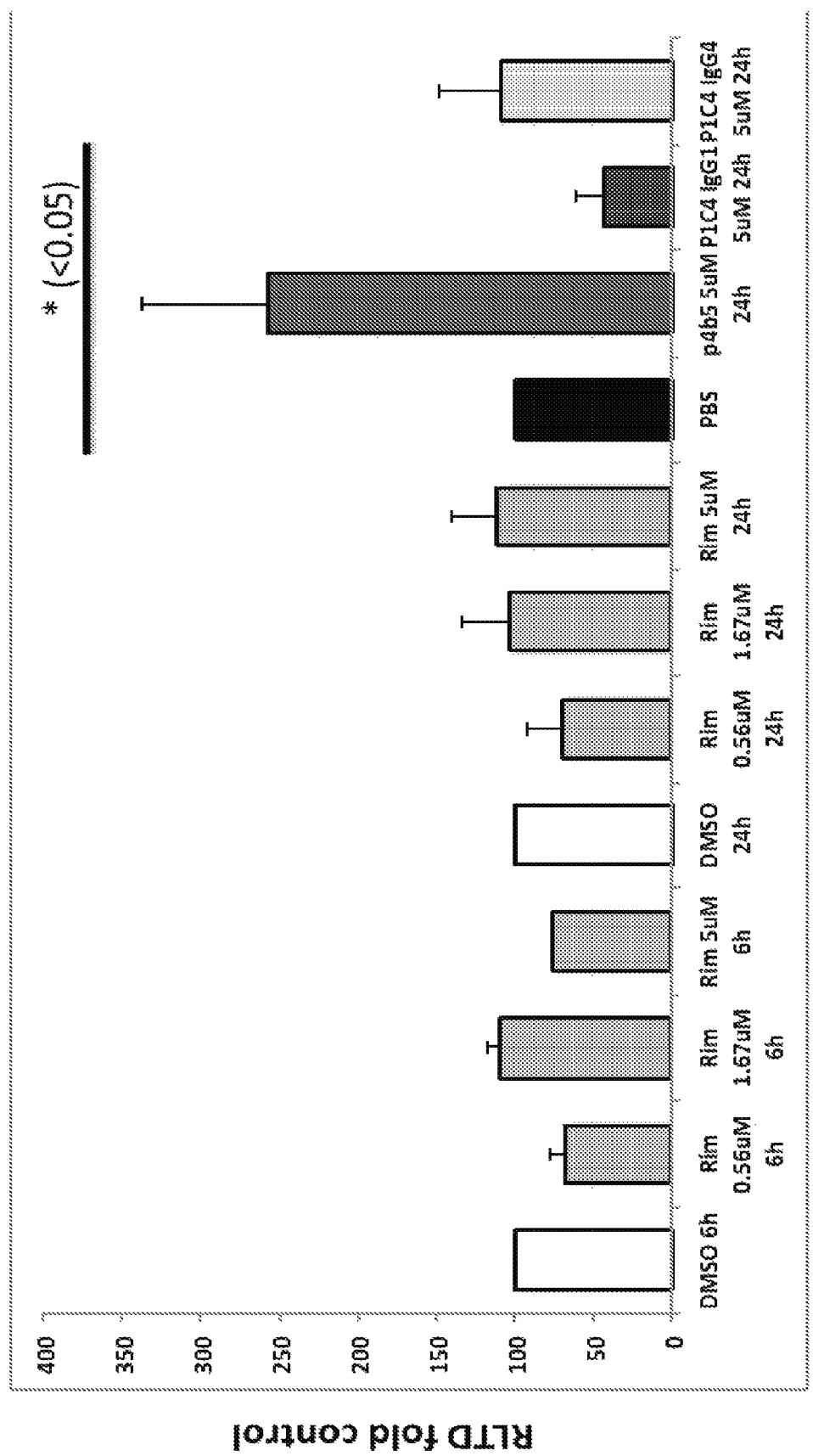
FIG. 29 shows RT-PCR expression data measuring TGFβ expression levels in primary hepatic stellate cells treated with the indicated antibodies, concentrations, and controls.
Figure 30:
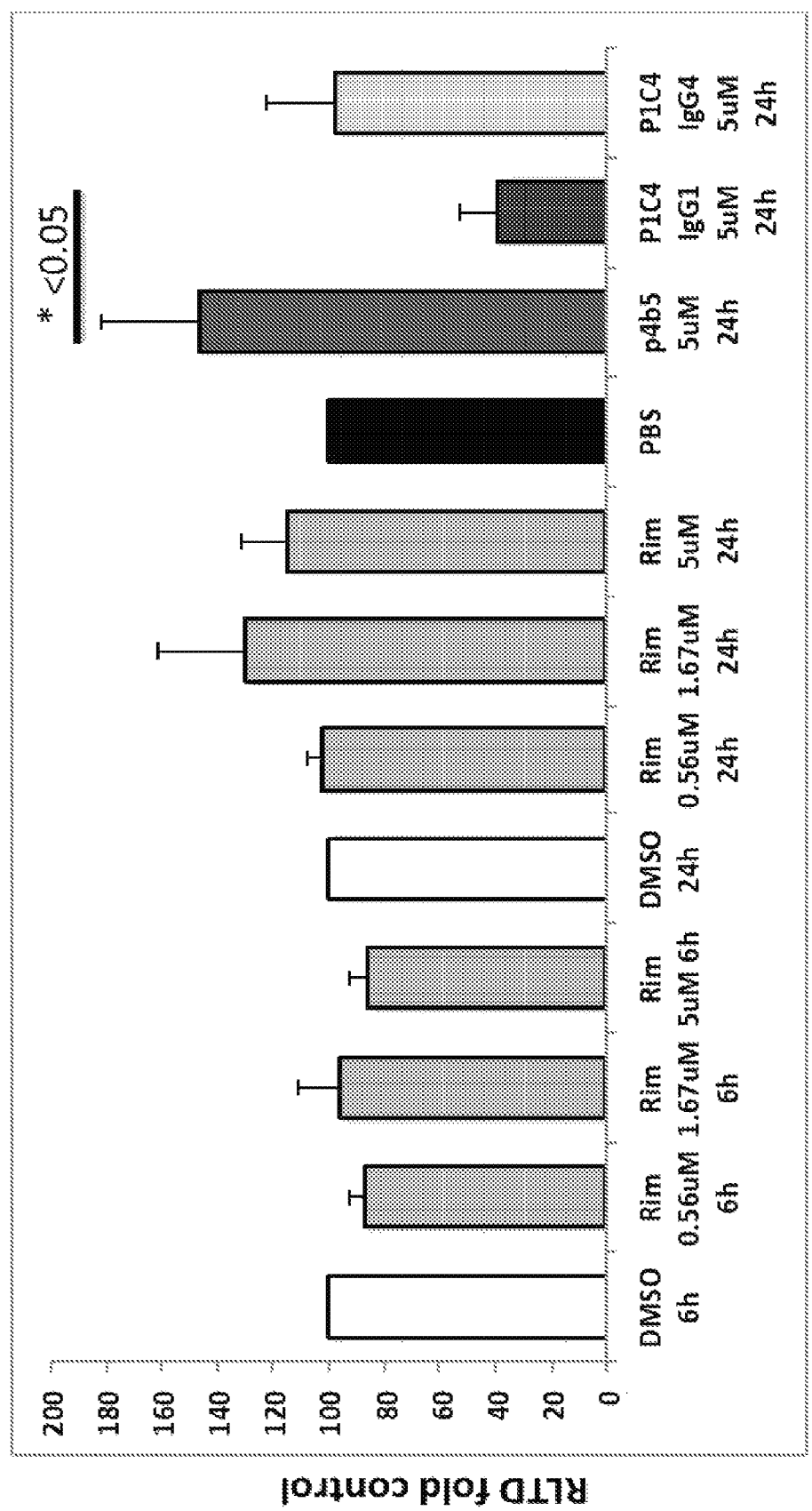
FIG. 30 shows RT-PCR expression data measuring TIMP1 expression levels in primary hepatic stellate cells treated with the indicated antibodies, concentrations, and controls.
Figure 31:
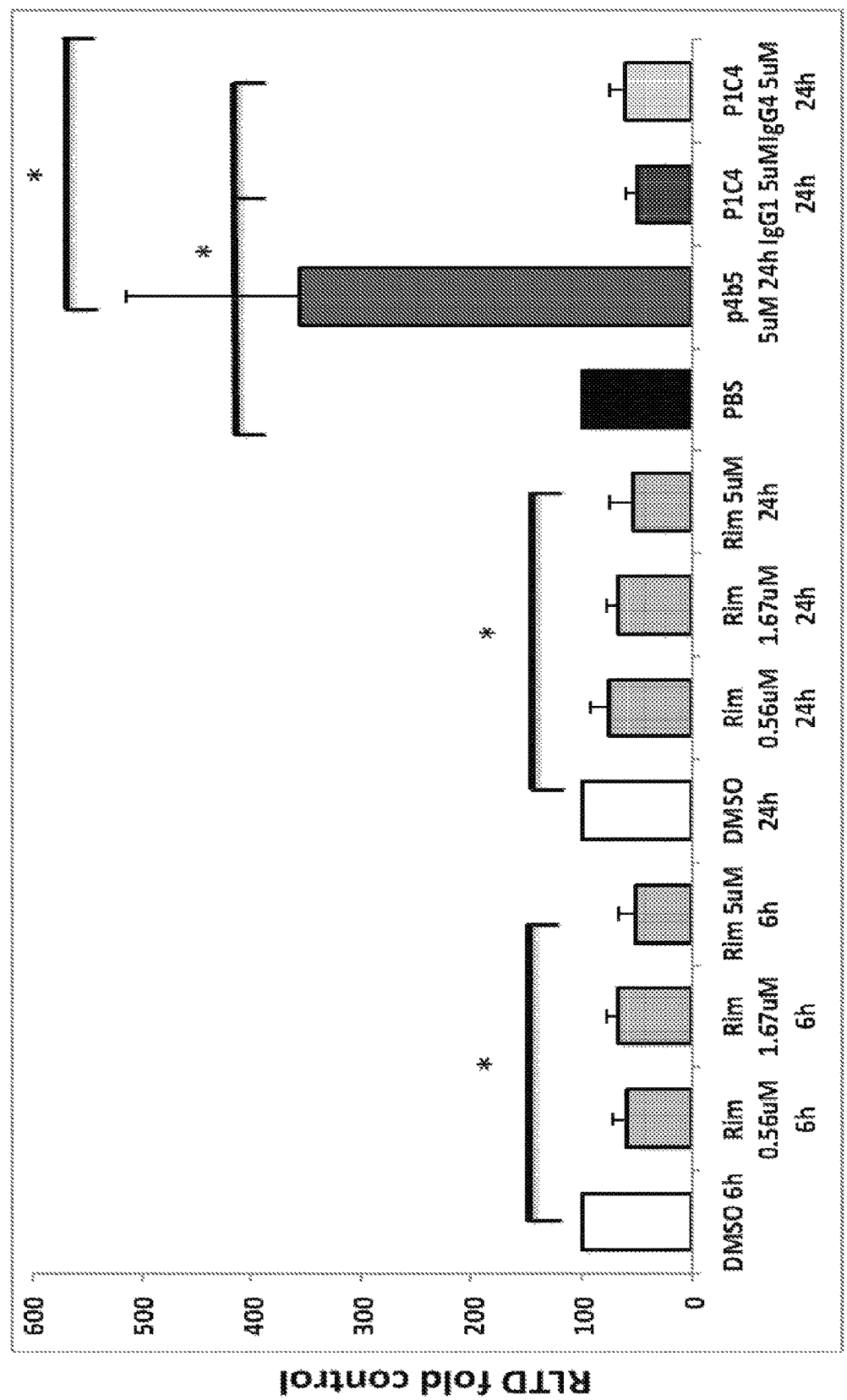
FIG. 31 shows RT-PCR expression data measuring α-SMA expression levels in primary hepatic stellate cells treated with the indicated antibodies, concentrations, and controls.

The results showed that there was a significant decrease in Pro-collagen A1(I) expression when the HSCs were treated with P1C4-h2 antibodies, but not with non-functional control and PBS (FIG. 28). There was also a significant decrease in TGFβ (FIG. 29) and TIMP1 (FIG. 30) expression compared to PBS and non-functional antibody controls. In addition, the decrease in α-SMA expression was also significant in cells treated with P1C4-IgG1 or IgG4 compared to that in PBS or non-functional binder treated cells (FIG. 31).

Example 30: Quantification of Anti-CB1 Antibody in Cynomolgus Monkey Cerebral Spinal Fluid (CSF)

Cynomolgus monkeys (2 male and 2 female/group) were treated with P1C4-h2-IgG4 according to the treatment scheme in Table 33, and CSF was collected at the indicated time points. P1C4-h2-IgG4 was quantified by ELISA coating 96 well plates with an anti-ID antibody at 1 ug/mL followed by the addition of CSF and detection with an HRP-conjugated anti-IgG antibody (Abcam) and color reagent.

As shown in Table 33, the antibody was only detected at very low levels if at all. In the highest dose group, less than 0.1% of the injected dose is detectable in the CSF indicating that antibody exposure of CNS is very low.

TABLE 33

Quantification of anti-CB1 antibody in cynomolgus monkey CSF

| Group | Timepoint | Concentration (ng/ml) | | | |
|---|---|---|---|---|---|
| 0.3 mg/kg IV | Pre-dose | BLQ | BLQ | BLQ | BLQ |
|  | 2 h post $1^{st}$ dose (d 1) | BLQ | BLQ | BLQ | BLQ |
|  | 2 h post $2^{nd}$ dose (d 8) | BLQ | BLQ | 35 | BLQ |
|  | 2 h post $3^{rd}$ dose (d 15) | BLQ | BLQ | BLQ | BLQ |
| 3 mg/kg SC | Pre-dose | BLQ | BLQ | BLQ | BLQ |
|  | 2 h post $1^{st}$ (d 1), $2^{nd}$ (d 8) and $3^{rd}$ dose (d 15) | BLQ | BLQ | BLQ | BLQ |
| 3 mg/kg IV | Pre-dose | BLQ | BLQ | BLQ | BLQ |
|  | 2 h post $1^{st}$ dose (d 1) | BLQ | BLQ | 37 | BLQ |
|  | 2 h post $2^{nd}$ dose (d 8) | 15 | BLQ | BLQ | BLQ |
|  | 2 h post $3^{rd}$ dose (d 15) | 21 | BLQ | BLQ | BLQ |
| 40 mg/kg IV | Pre-dose | BLQ | BLQ | NA | NA |
|  | 9 h post-dose | 86 | 136* | NA | NA |

BLQ = below limit of quantification

Example 31. Measuring Effects of Anti-CB1 Antibody on Metabolic and Cardiovascular Factors in Cynomolgus Monkeys The RIO program demonstrated the cardiometabolic effects of rimonabant treatment using several factors. See, e.g., Pi-Sunyer et al., 2006, J Am Coll Cardio, 147:362A. As such, the effect of the anti-CB1 antibodies disclosed herein is also evaluated for effects on similar cardiometabolic factors.

Obese cynomolgus and rhesus monkeys are treated with the anti-CB1 antibody P1C4-h2-IgG4 at 3 mg/kg or 0.3 mg/kg with weekly dosing s.c. For negative controls, a set of primates are injected with either (1) pharmaceutical carrier only; or (2) a control antibody known not to bind CB1. Effects on primate food intake, body weights, insulin sensitivity, triglyceride levels, and other cardiovascular risk factors are observed.

Primates treated with the anti-CB1 antibody P1C4-h2-IgG4 at 3 mg/kg or 0.3 mg/kg are shown to exhibit reduced triglyceride levels and other cardiovascular risk factors. Primates treated with the anti-CB1 antibody P1C4-h2-IgG4 at 3 mg/kg or 0.3 mg/kg are also shown to exhibit improved insulin sensitivity. Primates injected with either control antibody or carrier-only are observed without any improvement in these factors.

Numerous modifications and variations in the invention as set forth in the above illustrative examples are expected to occur to those skilled in the art. Consequently only such limitations as appear in the appended claims should be placed on the invention. All references cited herein are incorporated herein by reference in their entireties for all purposes.

TABLE 34

Sequences of allowable mutations within PA13R3-P1C4 CDRs

| Source Sequence Description | Sequence | Mutation | SEQ ID NO |
|---|---|---|---|
| Heavy chain CDR1 sequence | YYWMN | | 352 |
| | HYWMN | Y1→H | 443 |
| | IYWMN | Y1→I | 444 |
| | WYWMN | Y1→W | 445 |
| | YFWMN | Y2→F | 446 |
| | YKWMN | Y2→K | 447 |
| | YNWMN | Y2→N | 448 |
| | YYAMN | W3→A | 449 |
| | YYFMN | W3→F | 450 |
| | YYWAN | M4→A | 451 |
| | YYWEN | M4→E | 452 |
| | YYWFN | M4→F | 453 |
| | YYWLN | M4→L | 454 |
| | YYWNN | M4→N | 455 |
| | YYWQN | M4→Q | 456 |
| | YYWTN | M4→T | 457 |
| | YYWVN | M4→V | 458 |
| | YYWMI | N5→I | 459 |
| | YYWMK | N5→K | 460 |
| | YYWML | N5→L | 461 |
| | YYWMS | N5→S | 462 |
| | YYWMW | N5→W | 463 |
| Heavy chain CDR2 sequence | QIYPGDGETKY | | 353 |
| | DIYPGDGETKY | Q1→D | 464 |
| | EIYPGDGETKY | Q1→E | 465 |
| | QAYPGDGETKY | I2→A | 466 |
| | QDYPGDGETKY | I2→D | 467 |
| | QEYPGDGETKY | I2→E | 468 |
| | QFYPGDGETKY | I2→F | 469 |
| | QGYPGDGETKY | I2→G | 470 |
| | QHYPGDGETKY | I2→H | 471 |
| | QKYPGDGETKY | I2→K | 472 |
| | QLYPGDGETKY | I2→L | 473 |
| | QNYPGDGETKY | I2→N | 474 |
| | QQYPGDGETKY | I2→Q | 475 |
| | QRYPGDGETKY | I2→R | 476 |
| | QSYPGDGETKY | I2→S | 477 |
| | QTYPGDGETKY | I2→T | 478 |
| | QWYPGDGETKY | I2→W | 479 |
| | QYYPGDGETKY | I2→Y | 480 |
| | QIFPGDGETKY | Y3→F | 481 |
| | QIYAGDGETKY | P4→A | 482 |
| | QIYFGDGETKY | P4→F | 483 |
| | QIYHGDGETKY | P4→H | 484 |
| | QIYKGDGETKY | P4→K | 485 |
| | QIYPADGETKY | G5→A | 486 |

TABLE 34-continued

Sequences of allowable mutations within PA13R3-P1C4 CDRs

| Source Sequence Description | Sequence | Mutation | SEQ ID NO |
|---|---|---|---|
| | QIYPCDGETKY | G5→C | 487 |
| | QIYPDDGETKY | G5→D | 488 |
| | QIYPEDGETKY | G5→E | 489 |
| | QIYPFDGETKY | G5→F | 490 |
| | QIYPHDGETKY | G5→H | 491 |
| | QIYPIDGETKY | G5→I | 492 |
| | QIYPKDGETKY | G5→K | 493 |
| | QIYPLDGETKY | G5→L | 494 |
| | QIYPMDGETKY | G5→M | 495 |
| | QIYPQDGETKY | G5→Q | 496 |
| | QIYPRDGETKY | G5→R | 497 |
| | QIYPSDGETKY | G5→S | 498 |
| | QIYPTDGETKY | G5→T | 499 |
| | QIYPVDGETKY | G5→V | 500 |
| | QIYPWDGETKY | G5→W | 501 |
| | QIYPYDGETKY | G5→Y | 502 |
| | QIYPGIGETKY | D6→I | 503 |
| | QIYPGLGETKY | D6→L | 504 |
| | QIYPGMGETKY | D6→M | 505 |
| | QIYPGNGETKY | D6→N | 506 |
| | QIYPGPGETKY | D6→P | 507 |
| | QIYPGQGETKY | D6→Q | 508 |
| | QIYPGVGETKY | D6→V | 509 |
| | QIYPGWGETKY | D6→W | 510 |
| | QIYPGYGETKY | D6→Y | 511 |
| | QIYPGDAETKY | G7→A | 512 |
| | QIYPGDDETKY | G7→D | 513 |
| | QIYPGDEETKY | G7→E | 514 |
| | QIYPGDFETKY | G7→F | 515 |
| | QIYPGDHETKY | G7→H | 516 |
| | QIYPGDIETKY | G7→I | 517 |
| | QIYPGDKETKY | G7→K | 518 |
| | QIYPGDLETKY | G7→L | 519 |
| | QIYPGDMETKY | G7→M | 520 |
| | QIYPGDNETKY | G7→N | 521 |
| | QIYPGDPETKY | G7→P | 522 |
| | QIYPGDQETKY | G7→Q | 523 |
| | QIYPGDRETKY | G7→R | 524 |
| | QIYPGDSETKY | G7→S | 525 |
| | QIYPGDTETKY | G7→T | 526 |
| | QIYPGDVETKY | G7→V | 527 |
| | QIYPGDYETKY | G7→Y | 528 |
| | QIYPGDGATKY | E8→A | 529 |
| | QIYPGDGDTKY | E8→D | 530 |
| | QIYPGDGMTKY | E8→M | 531 |
| | QIYPGDGQTKY | E8→Q | 532 |
| | QIYPGDGVTKY | E8→V | 533 |
| | QIYPGDGYTKY | E8→Y | 534 |
| | QIYPGDGEAKY | T9→A | 535 |
| | QIYPGDGEDKY | T9→D | 536 |
| | QIYPGDGEEKY | T9→E | 537 |
| | QIYPGDGEFKY | T9→F | 538 |
| | QIYPGDGEGKY | T9→G | 539 |
| | QIYPGDGEHKY | T9→H | 540 |
| | QIYPGDGEIKY | T9→I | 541 |
| | QIYPGDGEKKY | T9→K | 542 |
| | QIYPGDGEQKY | T9→Q | 543 |
| | QIYPGDGERKY | T9→R | 544 |
| | QIYPGDGESKY | T9→S | 545 |
| | QIYPGDGETKY | T9→T | 546 |
| | QIYPGDGEVKY | T9→W | 547 |
| | QIYPGDGEYKY | T9→Y | 548 |
| | QIYPGDGETDY | K10→D | 549 |
| | QIYPGDGETEY | K10→E | 550 |
| | QIYPGDGETHY | K10→H | 551 |
| | QIYPGDGETIY | K10→I | 552 |
| | QIYPGDGETLY | K10→L | 553 |
| | QIYPGDGETMY | K10→M | 554 |
| | QIYPGDGETNY | K10→N | 555 |
| | QIYPGDGETPY | K10→P | 556 |
| | QIYPGDGETQY | K10→Q | 557 |
| | QIYPGDGETRY | K10→R | 558 |
| | QIYPGDGETSY | K10→S | 559 |
| | QIYPGDGETTY | K10→T | 560 |

TABLE 34-continued

Sequences of allowable mutations within PA13R3-P1C4 CDRs

| Source Sequence Description | Sequence | Mutation | SEQ ID NO |
|---|---|---|---|
| | QIYPGDGETVY | K10→V | 561 |
| | QIYPGDGETWY | K10→W | 562 |
| | QIYPGDGETYY | K10→Y | 563 |
| | QIYPGDGETKC | Y11→C | 564 |
| | QIYPGDGETKD | Y11→D | 565 |
| | QIYPGDGETKE | Y11→E | 566 |
| | QIYPGDGETKF | Y11→F | 567 |
| | QIYPGDGETKG | Y11→G | 568 |
| | QIYPGDGETKH | Y11→H | 569 |
| | QIYPGDGETKI | Y11→I | 570 |
| | QIYPGDGETKL | Y11→L | 571 |
| | QIYPGDGETKN | Y11→N | 572 |
| | QIYPGDGETKP | Y11→P | 573 |
| | QIYPGDGETKQ | Y11→Q | 574 |
| | QIYPGDGETKR | Y11→R | 575 |
| | QIYPGDGETKT | Y11→T | 576 |
| | QIYPGDGETKW | Y11→W | 577 |
| Heavy chain CDR3 sequence | SHGNYLPY | | 354 |
| | NHGNYLPY | S1→N | 578 |
| | THGNYLPY | S1→T | 579 |
| | YHGNYLPY | S1→Y | 580 |
| | SHGNALPY | Y5→A | 581 |
| | SHGNCLPY | Y5→C | 582 |
| | SHGNFLPY | Y5→F | 583 |
| | SHGNHLPY | Y5→H | 584 |
| | SHGNNLPY | Y5→N | 585 |
| | SHGNSLPY | Y5→S | 586 |
| | SHGNYDPY | L6→D | 587 |
| | SHGNYEPY | L6→E | 588 |
| | SHGNYFPY | L6→F | 589 |
| | SHGNYGPY | L6→G | 590 |
| | SHGNYHPY | L6→H | 591 |
| | SHGNYIPY | L6→I | 592 |
| | SHGNYKPY | L6→K | 593 |
| | SHGNYMPY | L6→M | 594 |
| | SHGNYNPY | L6→N | 595 |
| | SHGNYQPY | L6→Q | 596 |
| | SHGNYSPY | L6→S | 597 |
| | SHGNYWPY | L6→W | 598 |
| | SHGNYYPY | L6→Y | 599 |
| | SHGNYLAY | P7→A | 600 |
| | SHGNYLEY | P7→E | 601 |
| | SHGNYLFY | P7→F | 602 |
| | SHGNYLGY | P7→G | 603 |
| | SHGNYLHY | P7→H | 604 |
| | SHGNYLKY | P7→K | 605 |
| | SHGNYLLY | P7→L | 606 |
| | SHGNYLQY | P7→Q | 607 |
| | SHGNYLRY | P7→R | 608 |
| | SHGNYLSY | P7→S | 609 |
| | SHGNYLVY | P7→V | 610 |
| | SHGNYLWY | P7→W | 611 |
| | SHGNYLYY | P7→Y | 612 |
| | SHGNYLPA | Y8→A | 613 |
| | SHGNYLPD | Y8→D | 614 |
| | SHGNYLPE | Y8→E | 615 |
| | SHGNYLPF | Y8→F | 616 |
| | SHGNYLPG | Y8→G | 617 |
| | SHGNYLPH | Y8→H | 618 |
| | SHGNYLPI | Y8→I | 619 |
| | SHGNYLPK | Y8→K | 620 |
| | SHGNYLPL | Y8→L | 621 |
| | SHGNYLPM | Y8→M | 622 |
| | SHGNYLPR | Y8→R | 623 |
| | SHGNYLPS | Y8→S | 624 |
| | SHGNYLPV | Y8→V | 625 |
| Light chain CDR1 sequence | SSYLH | | 355 |
| | ASYLH | S1→A | 626 |
| | DSYLH | S1→D | 627 |
| | FSYLH | S1→F | 628 |

TABLE 34-continued

Sequences of allowable mutations within PA13R3-P1C4 CDRs

| Source Sequence Description | Sequence | Mutation | SEQ ID NO |
|---|---|---|---|
| | LSYLH | S1→L | 629 |
| | MSYLH | S1→M | 630 |
| | RSYLH | S1→R | 631 |
| | TSYLH | S1→T | 632 |
| | VSYLH | S1→V | 633 |
| | WSYLH | S1→W | 634 |
| | YSYLH | S1→Y | 635 |
| | SAYLH | S2→A | 636 |
| | SDYLH | S2→D | 637 |
| | SEYLH | S2→E | 638 |
| | SFYLH | S2→F | 639 |
| | SGYLH | S2→G | 640 |
| | SHYLH | S2→H | 641 |
| | SKYLH | S2→K | 642 |
| | SMYLH | S2→M | 643 |
| | SNYLH | S2→N | 644 |
| | SPYLH | S2→P | 645 |
| | SQYLH | S2→Q | 646 |
| | SRYLH | S2→R | 833 |
| | SVYLH | S2→V | 647 |
| | SWYLH | S2→W | 648 |
| | SSFLH | Y3→F | 649 |
| | SSYFH | L4→F | 650 |
| | SSYHH | L4→H | 651 |
| | SSYIH | L4→I | 652 |
| | SSYKH | L4→K | 653 |
| | SSYNH | L4→N | 654 |
| | SSYPH | L4→P | 655 |
| | SSYQH | L4→Q | 656 |
| | SSYRH | L4→R | 657 |
| | SSYSH | L4→S | 658 |
| | SSYTH | L4→T | 659 |
| | SSYWH | L4→W | 660 |
| | SSYYH | L4→Y | 661 |
| Light chain CDR2 sequence | STSNLAS | | 356 |
| | ATSNLAS | S1→A | 662 |
| | GTSNLAS | S1→G | 834 |
| | HTSNLAS | S1→H | 663 |
| | NTSNLAS | S1→N | 664 |
| | RTSNLAS | S1→R | 665 |
| | SASNLAS | T2→A | 666 |
| | SDSNLAS | T2→D | 667 |
| | SFSNLAS | T2→F | 668 |
| | SGSNLAS | T2→G | 669 |
| | SHSNLAS | T2→H | 670 |
| | SLSNLAS | T2→L | 671 |
| | SMSNLAS | T2→M | 672 |
| | SSSNLAS | T2→S | 673 |
| | SVSNLAS | T2→V | 674 |
| | SWSNLAS | T2→W | 675 |
| | SYSNLAS | T2→Y | 676 |
| | STDNLAS | S3→D | 677 |
| | STFNLAS | S3→F | 678 |
| | STHNLAS | S3→H | 679 |
| | STINLAS | S3→I | 680 |
| | STKNLAS | S3→K | 681 |
| | STLNLAS | S3→L | 682 |
| | STNNLAS | S3→N | 683 |
| | STQNLAS | S3→Q | 684 |
| | STYNLAS | S3→Y | 685 |
| | STSDLAS | N4→D | 686 |
| | STSELAS | N4→E | 687 |
| | STSFLAS | N4→F | 688 |
| | STSGLAS | N4→G | 689 |
| | STSHLAS | N4→H | 690 |
| | STSILAS | N4→I | 691 |
| | STSKLAS | N4→K | 692 |
| | STSQLAS | N4→Q | 693 |
| | STSRLAS | N4→R | 694 |
| | STSSLAS | N4→S | 695 |
| | STSVLAS | N4→V | 696 |
| | STSNDAS | L5→D | 697 |

TABLE 34-continued

| Sequences of allowable mutations within PA13R3-P1C4 CDRs | | | |
|---|---|---|---|
| Source Sequence Description | Sequence | Mutation | SEQ ID NO |
| | STSNEAS | L5→E | 698 |
| | STSNFAS | L5→F | 699 |
| | STSNGAS | L5→G | 700 |
| | STSNHAS | L5→H | 701 |
| | STSNIAS | L5→I | 702 |
| | STSNKAS | L5→K | 703 |
| | STSNMAS | L5→M | 704 |
| | STSNNAS | L5→N | 705 |
| | STSNPAS | L5→P | 706 |
| | STSNQAS | L5→Q | 707 |
| | STSNRAS | L5→R | 835 |
| | STSNVAS | L5→V | 708 |
| | STSNWAS | L5→W | 709 |
| | STSNYAS | L5→Y | 710 |
| | STSNLDS | A6→D | 711 |
| | STSNLFS | A6→F | 712 |
| | STSNLGS | A6→G | 713 |
| | STSNLIS | A6→I | 714 |
| | STSNLKS | A6→K | 715 |
| | STSNLQS | A6→Q | 716 |
| | STSNLRS | A6→R | 717 |
| | STSNLSS | A6→S | 718 |
| | STSNLVS | A6→V | 719 |
| | STSNLWS | A6→W | 720 |
| | STSNLAA | S7→A | 721 |
| | STSNLAD | S7→D | 722 |
| | STSNLAF | S7→F | 723 |
| | STSNLAG | S7→G | 724 |
| | STSNLAH | S7→H | 725 |
| | STSNLAK | S7→K | 726 |
| | STSNLAL | S7→L | 727 |
| | STSNLAR | S7→R | 728 |
| | STSNLAT | S7→T | 729 |
| | STSNLAV | S7→V | 730 |
| | STSNLAW | S7→W | 731 |
| | STSNLASG | | 732 |
| | STSNLASA | G8→A | 733 |
| | STSNLASF | G8→F | 734 |
| | STSNLASI | G8→I | 735 |
| | STSNLASN | G8→N | 736 |
| | STSNLASP | G8→P | 737 |
| | STSNLASR | G8→R | 738 |
| | STSNLASS | G8→S | 739 |
| | STSNLAST | G8→T | 740 |
| | STSNLASV | G8→V | 741 |
| | STSNLASY | G8→Y | 742 |
| Light chain CDR3 sequence | HQYHRSPPTF | | 357 |
| | AQYHRSPPTF | H1→A | 743 |
| | CQYHRSPPTF | H1→C | 744 |
| | DQYHRSPPTF | H1→D | 745 |
| | EQYHRSPPTF | H1→E | 746 |
| | FQYHRSPPTF | H1→F | 747 |
| | IQYHRSPPTF | H1→I | 748 |
| | KQYHRSPPTF | H1→K | 749 |
| | LQYHRSPPTF | H1→L | 750 |
| | NQYHRSPPTF | H1→N | 751 |
| | QQYHRSPPTF | H1→Q | 836 |
| | RQYHRSPPTF | H1→R | 752 |
| | SQYHRSPPTF | H1→S | 753 |
| | TQYHRSPPTF | H1→T | 754 |
| | VQYHRSPPTF | H1→V | 755 |
| | WQYHRSPPTF | H1→W | 756 |
| | YQYHRSPPTF | H1→Y | 757 |
| | HAYHRSPPTF | Q2→A | 758 |
| | HCYHRSPPTF | Q2→C | 759 |
| | HEYHRSPPTF | Q2→E | 760 |
| | HGYHRSPPTF | Q2→G | 761 |
| | HNYHRSPPTF | Q2→N | 762 |
| | HSYHRSPPTF | Q2→S | 763 |
| | HTYHRSPPTF | Q2→T | 764 |
| | HVYHRSPPTF | Q2→V | 765 |
| | HQAHRSPPTF | Y3→A | 766 |
| | HQFHRSPPTF | Y3→F | 767 |
| | HQGHRSPPTF | Y3→G | 768 |
| | HQHHRSPPTF | Y3→H | 769 |
| | HQQHRSPPTF | Y3→Q | 770 |
| | HQWHRSPPTF | Y3→W | 771 |
| | HQYARSPPTF | H4→A | 772 |
| | HQYERSPPTF | H4→E | 773 |
| | HQYGRSPPTF | H4→G | 774 |
| | HQYKRSPPTF | H4→K | 775 |
| | HQYLRSPPTF | H4→L | 776 |
| | HQYNRSPPTF | H4→N | 777 |
| | HQYQRSPPTF | H4→Q | 778 |
| | HQYSRSPPTF | H4→S | 779 |
| | HQYTRSPPTF | H4→T | 780 |
| | HQYVRSPPTF | H4→V | 781 |
| | HQYWRSPPTF | H4→W | 782 |
| | HQYHASPPTF | R5→A | 783 |
| | HQYHCSPPTF | R5→C | 784 |
| | HQYHDSPPTF | R5→D | 785 |
| | HQYHESPPTF | R5→E | 786 |
| | HQYHFSPPTF | R5→F | 787 |
| | HQYHISPPTF | R5→I | 788 |
| | HQYHLSPPTF | R5→L | 789 |
| | HQYHMSPPTF | R5→M | 790 |
| | HQYHNSPPTF | R5→N | 791 |
| | HQYHQSPPTF | R5→Q | 792 |
| | HQYHVSPPTF | R5→V | 793 |
| | HQYHWSPPTF | R5→W | 794 |
| | HQYHYSPPTF | R5→Y | 795 |
| | HQYHRAPPTF | S6→A | 796 |
| | HQYHRCPPTF | S6→C | 797 |
| | HQYHREPPTF | S6→E | 798 |
| | HQYHRFPPTF | S6→F | 799 |
| | HQYHRGPPTF | S6→G | 800 |
| | HQYHRIPPTF | S6→I | 801 |
| | HQYHRMPPTF | S6→M | 802 |
| | HQYHRPPPTF | S6→P | 803 |
| | HQYHRRPPTF | S6→R | 804 |
| | HQYHRTPPTF | S6→T | 805 |
| | HQYHRVPPTF | S6→V | 806 |
| | HQYHRWPPTF | S6→W | 807 |
| | HQYHRYPPTF | S6→Y | 808 |
| | HQYHRSKPTF | P7→K | 809 |
| | HQYHRSWPTF | P7→W | 810 |
| | HQYHRSYPTF | P7→Y | 811 |
| | HQYHRSPDTF | P8→D | 812 |
| | HQYHRSPHTF | P8→H | 813 |
| | HQYHRSPPDF | T9→D | 814 |
| | HQYHRSPPFF | T9→F | 815 |
| | HQYHRSPPGF | T9→G | 816 |
| | HQYHRSPPIF | T9→I | 817 |
| | HQYHRSPPLF | T9→L | 818 |
| | HQYHRSPPMF | T9→M | 819 |
| | HQYHRSPPNF | T9→N | 820 |
| | HQYHRSPPQF | T9→Q | 821 |
| | HQYHRSPPRF | T9→R | 822 |
| | HQYHRSPPSF | T9→S | 823 |
| | HQYHRSPPVF | T9→V | 824 |
| | HQYHRSPPYF | T9→Y | 825 |

Example 32. Affinity Maturation of Anti-CB1 Antibody P1C4-h2-IgG4

In order to obtain more potent variants of P1C4-h2-IgG4 an affinity maturation campaign was carried out by constructing three large yeast display libraries containing randomized CDR residues and using magnetic-activated cell sorting (MACS) and FACS to select improved binders. For additional details see, for example, Wang et al., 2011, J Biol Chem. 286(51): 44218-44233. The design of the libraries was based on an analysis of the variability of CDR residues in a large database of natural human antibodies of the same germline families as P1C4-h2-IgG4 (VH1 family member 1-69 and Vk3 family member 3-20). The CDR residues that were selected for randomization are underlined below in Table 35.

TABLE 35

Residues randomized in P1C4 affinity maturation libraries

| Antibody Name/ Sequence Description | Sequence | SEQ ID NO: |
|---|---|---|
| P1C4-H2-IgG4 | QVQLVQSGAEVKKPGSSVKVSCKASGYEFSYYWMNWVRQAPGQGLE WMGQIYPGDGETKYAQKFQGRVTITADKSTSTAYMELSSLRSEDTAVY YCARSHGNYLPYWGQGTLVTVSSASTKGPSVFPLAPCSRSTSESTAALG CLVKDYFPEPVTVSWNSGALTSGVHTFPAVLQSSGLYSLSSVVTVPSSS LGTKTYTCNVDHKPSNTKVDKRVESKYGPPCPPCPAPEFLGGPSVFLFP PKPKDTLMISRTPEVTCVVVDVSQEDPEVQFNWYVDGVEVHNAKTKPR EEQFNSTYRVVSVLTVLHQDWLNGKEYKCKVSNKGLPSSIEKTISKAKG QPREPQVYTLPPSQEEMTKNQVSLTCLVKGFYPSDIAVEWESNGQPENN YKTTPPVLDSDGSFFLYSRLTVDKSRWQEGNVFSCSVMHEALHNHYTQ KSLSLSLGK | 437 |
| P1C4-LC-humanized | EIVLTQSPATLSLSPGERATLSCRASQSVSSSYLHWYQQKPGQAPRLLIY STSNLASGIPARFSGSGSGTDFTLTISRLEPEDFAVYYCHQYHRSPPTFGQ GTKVEIKRTVAAPSVFIFPPSDEQLKSGTASVVCLLNNFYPREAKVQWK VDNALQSGNSQESVTEQDSKDSTYSLSSTLTLSKADYEKHKVYACEVT HQGLSSPVTKSFNRGEC | 828 |

The three yeast display libraries were designed to carry mutations in (1) the light chain only, (2) the heavy chain only, or (3) in both the light and heavy chains. The theoretical diversity of each library was $6.5 \times 10^3$, $1.4 \times 10^5$ and $9.0 \times 10^8$ and the actual size of each library was $1.5 \times 10^5$, $5.0 \times 10^7$ and $2.3 \times 10^9$ respectively.

After several rounds of MACS and FACS selection, with progressively lower concentrations of CB1 iCAPS, four clones were identified that showed potentially higher affinity for CB1. All four clones had changes only in the light chain CDRs, and carried unchanged parental heavy chains. The sequences of the novel light chains are shown below in Table 36 with the altered residues underlined.

TABLE 36

Sequences of Affinity Matured P1C4 Clones

| Antibody Name/ Sequence Description | Sequence | SEQ ID NO: |
|---|---|---|
| RY-LC-B12 FACS3 | EIVLTQSPATLSLSPGERATLSCRASQSVSSRYLHWYQQKPGQAP RLLIYSTSRLASGIPARFSGSGSGTDFTLTISRLEPEDFAVYYCQQY HRSPPTFGQGTKVEIKRTVAAPSVFIFPPSDEQLKSGTASVVCLLN NFYPREAKVQWKVDNALQSGNSQESVTEQDSKDSTYSLSSTLTL SKADYEKHKVYACEVTHQGLSSPVTKSFNRGEC | 829 |
| RY-LC-A10 FACS5 | EIVLTQSPATLSLSPGERATLSCRASQSVSSRYLHWYQQKPGQAP RLLIYSTSNRASGIPARFSGSGSGTDFTLTISRLEPEDFAVYYCQQY HRSPPTFGQGTKVEIKRTVAAPSVFIFPPSDEQLKSGTASVVCLLN NFYPREAKVQWKVDNALQSGNSQESVTEQDSKDSTYSLSSTLTL SKADYEKHKVYACEVTHQGLSSPVTKSFNRGEC | 830 |
| RY-HL-LC-C12 FACS4 | EIVLTQSPATLSLSPGERATLSCRASQSVSSRYLHWYQQKPGQAP RLLIYSTSRLASGIPARFSGSGSGTDFTLTISRLEPEDFAVYYCHQY HRSPPTFGQGTKVEIKRTVAAPSVFIFPPSDEQLKSGTASVVCLLN NFYPREAKVQWKVDNALQSGNSQESVTEQDSKDSTYSLSSTLTL SKADYEKHKVYACEVTHQGLSSPVTKSFNRGEC | 831 |
| RY-HL-LC-A12 FACS4 | EIVLTQSPATLSLSPGERATLSCRASQSVSSRYLHWYQQKPGQAP RLLIYGTSNLASGIPARFSGSGSGTDFTLTISRLEPEDFAVYYCHQY SRSPPTFGQGTKVEIKRTVAAPSVFIFPPSDEQLKSGTASVVCLLN NFYPREAKVQWKVDNALQSGNSQESVTEQDSKDSTYSLSSTLTL SKADYEKHKVYACEVTHQGLSSPVTKSFNRGEC | 832 |

The individual residues found to be altered in the light chains of the affinity matured P1C4 variants are summarized below in Table 37.

TABLE 37

Summary of Amino Acid Changes in Affinity Matured Clones

| Source Sequence Description | Sequence | Mutation | SEQ ID NO |
|---|---|---|---|
| Light chain CDR1 sequence | SSYLH | | 355 |
| | SRYLH | S2->R | 833 |
| Light chain CDR2 sequence | STSNLAS | | 356 |
| | GTSNLAS | S1->G | 834 |
| | STSRLAS | N4->R | 694 |
| | STSNRAS | L5->R | 835 |
| Light chain CDR3 sequence | HQYHRSPPTF | | 357 |
| | QQYHRSPPTF | H1->Q | 836 |
| | HQYSRSPPTF | H4->S | 779 |

The four affinity matured P1C4 variants that were identified via the yeast display selections were then reformatted from the yeast display vector to full length IgG4 (bearing a hinge mutation at S228P) and tested for improved binding affinity and antagonist function. Each antibody was expressed in 293 cells and purified by Protein A affinity chromatography. Parental P1C4-h2-IgG4 was also expressed and purified in an identical manner to ensure a comparable control was available.

Improvement in binding affinity of the four affinity matured P1C4 variants was assessed by flow cytometry on TRex-CHO cells expressing full length native human CB1, with TRex-CHO parental cells serving as the negative control. Briefly, 100 μl of 1×10$^6$ cells/ml of cells were incubated with P1C4 affinity matured variants and parental P1C4 IgGs in 3-fold serial dilutions starting from 104 to 1.3 nM for 30 minutes on ice. After being washed with 200 μL of FACS buffer twice, cells were incubated with secondary antibody for 30 minutes on ice. Cells were washed with 200 μL of FACS buffer twice and transferred to BD Falcon 5 mL tube and analyzed by FACS. Data analysis and measurement of binding affinity ($K_D$) was performed using GraphPad Prism software. The results are summarized in Tables 38. Binding affinity was enhanced approximately 2-3 fold for all four clones in comparison to parental P1C4-h2-IgG4.

TABLE 38

Summary of dissociation constants of P1C4 affinity matured clones

| Clone | Exp 1 $K_D$ (nM) | Exp 2 $K_D$ (nM) | Mean $K_D$ (nM) |
|---|---|---|---|
| RY-LC-B12_FACS3 | 8.75 | 8.89 | 8.82 |
| RY-LC-A10_FACS5 | N/A | 12.41 | 12.41 |
| RY-HL-LC-C12_FACS4 | 14.36 | 13.90 | 14.13 |
| RY-HL-LC-A12_FACS4 | 11.51 | 9.19 | 10.35 |
| Parental P1C4-h2-IgG4 | N/A | 24.14 | 24.14 |

Functional activity of the affinity matured P1C4 variants was quantified by cAMP antagonist assay using a commercially available cAMP kit based on a competitive immunoassay using cryptate-labeled anti-cAMP antibody and d2-labeled cAMP (Cisbio). Eight thousand cells/well of human CB1 expressing TRex-CHO cells were seeded to a white 384-well plate followed by incubating mAb or control compound at various concentrations at 22° C. for 10 minutes. Five μM forskolin (Sigma Aldrich) and 9 nM CP55,940 (Sigma Aldrich) were added to the cells and incubated for 30 minutes at 22° C. to activate CB1 signaling. After 30 minutes incubation at 22° C., 5 μL cAMP-d2 and 5 μL anti-cAMP cryptate were added to the cells and incubated for 1 hour. FRET signal was detected with Envision multi-label plate reader (Perkin Elmer) at anti-cAMP cryptate excitation at 620 nm and emission at 665 nm. Data analysis was performed using GraphPad Prism. The results are summarized in Table 39. Similar to the enhancement observed for binding affinity, functional potency was enhanced up to 2-3 fold in some affinity matured clones (RY-HL-LC-A12_FACS4 and RY-LC-B12_FACS3) in comparison to parental P1C4-h2-IgG4.

TABLE 39

Summary of IC$_{50}$ of P1C4 affinity matured clones

| Clone | Exp 1 IC$_{50}$ (nM) | Exp 2 IC$_{50}$ (nM) | Exp 3 IC$_{50}$ (nM) | Mean IC$_{50}$ ± SD (nM) |
|---|---|---|---|---|
| RY-LC-B12_FACS3 | 40.9 | 32.9 | 39.7 | 38 ± 4.3 |
| RY-LC-A10_FACS5 | 120.2 | 62.6 | 48.1 | 77 ± 38 |
| RY-HL-LC-C12_FACS4 | 76.76 | 52.5 | 43.1 | 57 ± 17.3 |
| RY-HL-LC-A12_FACS4 | 48 | 33.9 | 42.4 | 41 ± 7.1 |
| Parental P1C4-h2-IgG4 | 115.7 | 74.1 | 77.8 | 89 ± 23 |

SEQUENCE LISTING (836 sequences)

SEQ ID NO: 1 - DNA, 351 bp, Artificial Sequence
  PA13R3-P1C4 Heavy chain variable region
gaggtccagctgcagcagtctggggctgagctggtgaggcctggggtctcagtgaagatttcctgcaaggcttctggctatgaattcagttactactggatgaactgggtgaagcagaggcctggacagggtcttgagtggattggacagatttatcctggagatggtgaaactaagtacaatggaaagttcaagggtaaagccacactgactgcagacaaatcctccaacacagcctatatgcagctcagcagcctaacatctgaggactctgcggtctatttctgtgcaagatcccatggtaactaccttccttactggggccaagggactctggtcactgtctctgca

SEQ ID NO: 2 - protein, 117 aa, Artificial Sequence
  PA13R3-P1C4 Heavy chain variable region
EVQLQQSGAELVRPGVSVKISCKASGYEFSYYWMNWVKQRPGQGLEWIGQIYPGDGETKYNGKFKGKATLTADKSSNTAYMQLSSLTSEDSAVYFCARSHGNYLPYWGQGTLVTVSA

SEQ ID NO: 3 - DNA, 993 bp, Artificial Sequence
  PA13R3-P1C4 Heavy chain constant region
gcctccaccaagggcccatcggtcttccccctggcaccctcctccaagagcacctctgggggcacagcggccctgggctgcctggtcaaggactacttccccgaaccggtgacggtgtcatggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 4 - protein, 330 aa, Artificial Sequence [sequence omitted]

SEQ ID NO: 5 - DNA, 324 bp, Artificial Sequence
  PA13R3-P1C4 Light chain variable region
gatattgttctcacccagtctccagcaatcatgtctgcatctctaggggaacgggtcaccatgacctgcactgccagctcaagtgtaagttccagttacttgcactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgccaccagtatcatcgttccccacccacgttcggtgctgggaccaagctggagctgaaa

SEQ ID NO: 6 - protein, 108 aa, Artificial Sequence
  PA13R3-P1C4 Light chain variable region
DIVLTQSPAIMSASLGERVTMTCTASSSVSSSYLHWYQQKPGSSPKLWIYSTSNLASGVPARFSGSGSGTSYSLTISSMEAEDAATYYCHQYHRSPPTFGAGTKLELK

SEQ ID NO: 7 - DNA, 324 bp, Artificial Sequence
  PA13R3-P1C4 Light chain constant region
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagcttgcccgtcacaaagagcttcaacaggggagagtgttaa

SEQ ID NO: 8 - protein, 107 aa, Artificial Sequence
  PA13R3-P1C4 Light chain constant region
RTVAAPSVFIFPPSDEQLKSGTASVVCLLNNFYPREAKVQWKVDNALQSGNSQESVTEQDSKDSTYSLSSTLTLSKADYEKHKVYACEVTHQGLSLPVTKSFNRGEC

SEQ ID NO: 9 - DNA, 351 bp, Artificial Sequence
  36E12B6C2 Heavy chain variable region
caggttcagctgcagcagtctggggctgagctggtgaggcctgggtcctcagtgaagatttcctgcaaggcttctggctatgaattcagttactactggatgaactgggtgaagcagaggcctggacagggtcttcagtggattggacagatttatcctggagatggtgatactaactacaatggaaagttcaagggtaaagccacactgactgcagacaaatcctccagcacagcctacatgcacctcaccagcctaacgtctgaggactctgcggtctatttctgtgcaagatcggggggtaacccctttgctttctggggccaagggactctggtcactgtctctgca

SEQ ID NO: 10 - protein, 117 aa, Artificial Sequence
  36E12B6C2 Heavy chain variable region
QVQLQQSGAELVRPGSSVKISCKASGYEFSYYWMNWVKQRPGQGLQWIGQIYPGDGDTNYNGKFKGKATLTADKSSSTAYMHLTSLTSEDSAVYFCARSGGNPFAFWGQGTLVTVSA

SEQ ID NO: 11 - DNA, 993 bp, Artificial Sequence; identical to SEQ ID NO: 3
  36E12B6C2 Heavy chain constant region

SEQ ID NO: 12 - protein, 330 aa, Artificial Sequence [sequence omitted]

SEQ ID NO: 13 - DNA, 321 bp, Artificial Sequence
  36E12B6C2 Light chain variable region
gatatccagatgacacagacttcatcctccctgtctgcctctctgggagacagagtcaccttcagttgcagggcaagtcaggacattagcaattatttaaactggtatcagcagaaaccagatggaactgttaaactcctgatctactacacatcaagattacactcaggagtcacatcaaggttccgtggcagtgggtctggaacagattattctctcaccattagcaacctggagcaagaagacgttgccacttacttttgccaacagggtcatacgcttccgtggtcgttcggtggaggcaccaagctggaaatcaaa

SEQ ID NO: 14 - protein, 107 aa, Artificial Sequence
  36E12B6C2 Light chain variable region
DIQMTQTSSSLSASLGDRVTFSCRASQDISNYLNWYQQKPDGTVKLLIYYTSRLHSGVTSRFRGSGSGTDYSLTISNLEQEDVATYFCQQGHTLPWSFGGGTKLEIK

SEQ ID NO: 15 - DNA, 324 bp, Artificial Sequence
  36E12B6C2 Light chain constant region
cgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 16 - protein, 107 aa, Artificial Sequence [sequence omitted]

SEQ ID NO: 17 - DNA, 351 bp, Mus sp.; identical to SEQ ID NO: 9

SEQ ID NO: 18 - protein, 117 aa, Mus sp.; identical to SEQ ID NO: 10

SEQ ID NO: 19 - DNA, 993 bp, Mus sp.
gctaaaacaacagccccatcggtctatccactggcccctgtgtgtggagatacaactggctcctcggtgactctaggatgcctggtcaagggttatttccctgagccagtgaccttgacctggaactctggatccctgtccagtggtgtgcacaccttcccagctgtcctgcagtctgacctctacaccctcagcagctcagtgactgtaacctcgagcacctggcccagccagtccatcacctgcaatgtggcccacccggcaagcagcaccaaggtggacaagaaaattgagcccagagggcccacaatcaagccctgtcctccatgcaaatgcccagcacctaacctcttgggtggaccatccgtcttcatcttccctccaaagatcaaggatgtactcatgatctccctgagccccatagtcacatgtgtggtggtggatgtgagcgaggatgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggaccaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatga

SEQ ID NO: 20 - protein, 330 aa, Mus sp.
AKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 21 - DNA, 321 bp, Mus sp.; identical to SEQ ID NO: 13

SEQ ID NO: 22 - protein, 107 aa, Mus sp.; identical to SEQ ID NO: 14

SEQ ID NO: 23 - DNA, 324 bp, Mus sp.
cgggcagatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcgtcctgaacagttggactgatcaggacagcaaagacagcacctacagcatgagcagcaccctcacgttgaccaaggacgagtatgaacgacataacagctatacctgtgaggccactcacaagacatcaacttcacccattgtcaagagcttcaacaggaatgagtgttag

SEQ ID NO: 24 - protein, 107 aa, Mus sp.
RADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 25 - DNA, 351 bp, Artificial Sequence
  PA2LR3- P4B5 Heavy chain variable region
gaggttcagctgcagcagtctggggctgaactggtgaggcctgggtcctcagtgaagatttcctgcaaggcttctggctatgcattcagttattactggatgaactgggtgaagcagaggcctggacagggtcttgagtggattggacagatttatcctggagatggtgatactaactacagtggaaggttcaagggtaaagccacactgactgcagacaaatcctccagcacagcctacattcagctcagcagcctaacatctgaggactctgcggtctatttctgtgcaagatcgcacggtaactattttccttactggggccaagggactctggtcactgtctctgca

SEQ ID NO: 26 - protein, 117 aa, Artificial Sequence
  PA2LR3- P4B5 Heavy chain variable region
EVQLQQSGAELVRPGSSVKISCKASGYAFSYYWMNWVKQRPGQGLEWIGQIYPGDGDTNYSGRFKGKATLTADKSSSTAYIQLSSLTSEDSAVYFCARSHGNYFPYWGQGTLVTVSA

SEQ ID NO: 27 - DNA, 993 bp, Artificial Sequence; identical to SEQ ID NO: 3
  PA2LR3- P4B5 Heavy chain constant region

SEQ ID NO: 28 - protein, 330 aa, Artificial Sequence [sequence omitted]

SEQ ID NO: 29 - DNA, 324 bp, Artificial Sequence
  PA2LR3- P4B5 Light chain variable region
gacattgttctcaaccagtctccagcaatcatgtctgcatctctaggggaacgggtcaccatgacctgcactgccagctcaagtgtaagttccagttacttgcactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgccaccagtatcatcgttccccgctcacgttcggtgctgggaccaaactggaaataaaa

SEQ ID NO: 30 - protein, 108 aa, Artificial Sequence
  PA2LR3- P4B5 Light chain variable region
DIVLNQSPAIMSASLGERVTMTCTASSSVSSSYLHWYQQKPGSSPKLWIYSTSNLASGVPARFSGSGSGTSYSLTISSMEAEDAATYYCHQYHRSPLTFGAGTKLEIK

SEQ ID NO: 31 - DNA, 324 bp, Artificial Sequence; identical to SEQ ID NO: 7
  PA2LR3- P4B5 Light chain constant region

SEQ ID NO: 32 - protein, 107 aa, Artificial Sequence; identical to SEQ ID NO: 8
  PA2LR3- P4B5 Light chain constant region

SEQ ID NO: 33 - DNA, 351 bp, Artificial Sequence
  PA2LR3-P2D3 Heavy chain variable region
gaggttcagctgcagcagtctggggctgagctggtgaggcctgggtcctcagtgaagatttcctgcaaggcttctggctatgcattcagttactactggatgaactgggtgaagcagaggcctggacagggtcttgagtggattggacagatttatcctggagatggtgatactaactacaatggaaagttcaagggtaaagccacactgactgcagacaaatcctccagtacagcctacatgcagctcagcagcctaacatctgaggactctgcggtctatttctgtgcaagatcgcacggtagctattttgcttactggggccaagggactctggtcactgtctctgca

SEQ ID NO: 34 - protein, 117 aa, Artificial Sequence
  PA2LR3-P2D3 Heavy chain variable region
EVQLQQSGAELVRPGSSVKISCKASGYAFSYYWMNWVKQRPGQGLEWIGQIYPGDGDTNYNGKFKGKATLTADKSSSTAYMQLSSLTSEDSAVYFCARSHGSYFAYWGQGTLVTVSA

SEQ ID NO: 35 - DNA, 993 bp, Artificial Sequence; identical to SEQ ID NO: 3
  PA2LR3-P2D3 Heavy chain constant region

SEQ ID NO: 36 - protein, 330 aa, Artificial Sequence [sequence omitted]

SEQ ID NO: 37 - DNA, 333 bp, Artificial Sequence
  PA2LR3-P2D3 Light chain variable region
gatattgagctggcccaatctccagcttctttggctgtgtctctagggcagagggccaccatatcctgcagagccagtgaaagtgttgatagttatggcaatagttttatgcactggtaccagcagaaaccaggacagccacccaaactcctcatctatcttgcatccaacctagaatctggggtccctgccaggttcagcggcagtgggtctagggcagacttcaccctcaccattgatcctgtggaggctgatgatgctgcaacctattactgtctacaatatgctagttctcctcctacgttcggtgctgggaccaaactggaaataaaa

SEQ ID NO: 38 - protein, 111 aa, Artificial Sequence
  PA2LR3-P2D3 Light chain variable region
DIELAQSPASLAVSLGQRATISCRASESVDSYGNSFMHWYQQKPGQPPKLLIYLASNLESGVPARFSGSGSRADFTLTIDPVEADDAATYYCLQYASSPPTFGAGTKLEIK

SEQ ID NO: 39 - DNA, 324 bp, Artificial Sequence; identical to SEQ ID NO: 7
  PA2LR3-P2D3 Light chain constant region

SEQ ID NO: 40 - protein, 107 aa, Artificial Sequence; identical to SEQ ID NO: 8
  PA2LR3-P2D3 Light chain constant region

SEQ ID NO: 41 - DNA, 351 bp, Artificial Sequence
  PA2LR3-P4B1 Heavy chain variable region
gaggtccagcttcagcaatctggggctgagctggtgaggcctgggtcctcagtgaagatttcctgcaaggcttctggctttgcattcagtaactactggatgaactgggtgaagcagaggcctggacagggtcttgagtggattggacagatttatcctggagatggtgatactaacttcaatggaaagttcaagggtagagccatactgactgcagacatatcctccaacacagcctacatgcagctcagcagcctaacatctgaggactctgcggtctatttctgtgcaagatcgcacggtaactattttccttactggggccaagggactctggtcactgtctctgca

SEQ ID NO: 42 - protein, 117 aa, Artificial Sequence
  PA2LR3-P4B1 Heavy chain variable region
EVQLQQSGAELVRPGSSVKISCKASGFAFSNYWMNWVKQRPGQGLEWIGQIYPGDGDTNFNGKFKGRAILTADISSNTAYMQLSSLTSEDSAVYFCARSHGNYFPYWGQGTLVTVSA

SEQ ID NO: 43 - DNA, 993 bp, Artificial Sequence; identical to SEQ ID NO: 3
  PA2LR3-P4B1 Heavy chain constant region

SEQ ID NO: 44 - protein, 330 aa, Artificial Sequence [sequence omitted]

SEQ ID NO: 45 - DNA, 324 bp, Artificial Sequence
  PA2LR3-P4B1 Light chain variable region
caaattgtgttgacacagtctccagcaatcatgtctgcatctctaggggaacgggtcaccatgacctgcactgccagctcaagtgtaagttccagttacttgcactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgccaccagtatcatcgttccccgctcacgttcggtgctgggaccaagctggagctgaaa

SEQ ID NO: 46 - protein, 108 aa, Artificial Sequence
  PA2LR3-P4B1 Light chain variable region
QIVLTQSPAIMSASLGERVTMTCTASSSVSSSYLHWYQQKPGSSPKLWIYSTSNLASGVPARFSGSGSGTSYSLTISSMEAEDAATYYCHQYHRSPLTFGAGTKLELK

SEQ ID NO: 47 - DNA, 324 bp, Artificial Sequence; identical to SEQ ID NO: 7
  PA2LR3-P4B1 Light chain constant region

SEQ ID NO: 48 - protein, 107 aa, Artificial Sequence; identical to SEQ ID NO: 8
  PA2LR3-P4B1 Light chain constant region

SEQ ID NO: 49 - DNA, 351 bp, Artificial Sequence
  PA2LR3-P6B12 Heavy chain variable region
gaggtccagcttcagcaatctggggctgagctggtgaggcctgggtcctcagtgaagatttcctgcaaggcttctggctatgcattcagttactactggatgaactgggtgaagcagaggcctggacagggtcttgagtggattggacagatttatcctggagatggtgatactaactacaatggaaagttcaagggtaaagccacactgactgcagacaaatcctccagtacagcctacatgcagctcagcagcctaacatctgaggactctgcggtctatttctgtgcaagatcgcacggtaactattttgcttactggggccaagggactctggtcactgtctctgca

SEQ ID NO: 50 - protein, 117 aa, Artificial Sequence
  PA2LR3-P6B12 Heavy chain variable region
EVQLQQSGAELVRPGSSVKISCKASGYAFSYYWMNWVKQRPGQGLEWIGQIYPGDGDTNYNGKFKGKATLTADKSSSTAYMQLSSLTSEDSAVYFCARSHGNYFAYWGQGTLVTVSA

SEQ ID NO: 51 - DNA, 993 bp, Artificial Sequence; identical to SEQ ID NO: 3
  PA2LR3-P6B12 Heavy chain constant region

SEQ ID NO: 52 - protein, 330 aa, Artificial Sequence [sequence omitted]

SEQ ID NO: 53 - DNA, 324 bp, Artificial Sequence
  PA2LR3-P6B12 Light chain variable region
caaattgtactcacccagtctccagcaatcatgtctgcatctctaggggaacgggtcaccatgacctgcactgccagctcaagtgtaagttccagttacttgcactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgccaccagtatcatcgttcccccctcgcgttcggtgctgggaccaagctggagctgaaa

SEQ ID NO: 54 - protein, 108 aa, Artificial Sequence
  PA2LR3-P6B12 Light chain variable region
QIVLTQSPAIMSASLGERVTMTCTASSSVSSSYLHWYQQKPGSSPKLWIYSTSNLASGVPARFSGSGSGTSYSLTISSMEAEDAATYYCHQYHRSPLAFGAGTKLELK

SEQ ID NO: 55 - DNA, 324 bp, Artificial Sequence; identical to SEQ ID NO: 7
  PA2LR3-P6B12 Light chain constant region

SEQ ID NO: 56 - protein, 107 aa, Artificial Sequence; identical to SEQ ID NO: 8
  PA2LR3-P6B12 Light chain constant region

SEQ ID NO: 57 - DNA, 351 bp, Artificial Sequence
  PA2LR3-P6G7 Heavy chain variable region
gaggttcagcttcagcaatctggggctgagctggtgaggcctgggtcctcagtgaagatttcctgcaaggcttctggctttgcattcagtaactactggatgaactgggtgaagcagaggcccggacagggtcttgagtggattggacagatttatcctggagatggtgatactaacttcaatggaaagttcaagggtagagccatactgactgcagacatatcctccaacacagcctacatgcagctcagcagcctaacatctgaggactctgcggtctatttctgtgcaagatcgcacggtaactattttccttactggggccaagggactctggtcactgtctctgca

SEQ ID NO: 58 - protein, 117 aa, Artificial Sequence; identical to SEQ ID NO: 42
  PA2LR3-P6G7 Heavy chain variable region

SEQ ID NO: 59 - DNA, 993 bp, Artificial Sequence; identical to SEQ ID NO: 3
  PA2LR3-P6G7 Heavy chain constant region

SEQ ID NO: 60 - protein, 330 aa, Artificial Sequence [sequence omitted]

SEQ ID NO: 61 - DNA, 324 bp, Artificial Sequence
  PA2LR3-P6G7 Light chain variable region
gatattgtgctaactcagtctccagcaatcatgtccgcatctctaggggaacgggtcaccatgacctgcactgccagctcaagtgtaagttccagttacttacactggtaccagcagaagccaggatcctcccccaaactctggatttatagcacctccaacctggcttctggagtcccagctcgcttcagtggcagtgggtctgggacctcttactctctcacaatcagcagcatggaggctgaagatgctgccacttattactgccaccagcatcatcgttccccacccacgttcggtgctgggaccaagctggagctgaaa

SEQ ID NO: 62 - protein, 108 aa, Artificial Sequence
  PA2LR3-P6G7 Light chain variable region
DIVLTQSPAIMSASLGERVTMTCTASSSVSSSYLHWYQQKPGSSPKLWIYSTSNLASGVPARFSGSGSGTSYSLTISSMEAEDAATYYCHQHHRSPPTFGAGTKLELK

SEQ ID NO: 63 - DNA, 324 bp, Artificial Sequence; identical to SEQ ID NO: 7
  PA2LR3-P6G7 Light chain constant region

SEQ ID NO: 64 - protein, 107 aa, Artificial Sequence; identical to SEQ ID NO: 8
  PA2LR3-P6G7 Light chain constant region

SEQ ID NO: 65 - DNA, 351 bp, Artificial Sequence
  PA2LR3-P1G6 Heavy Chain Variable Region
gaggtgcagctgcagcagtctggggctgagctggtgaggcctgggtcctcagtgaagatttcctgcaaggcttctggctatgcattcagttactactggatgaactgggtgaagcagaggcctggacagggtcttgagtggattggacagatttatcctggagatggtgatactaactacaatgggaagttcaagggtaaagccacactgactgtagacaaatcctccagtacagcctacatgcagctcagcagcctaacatctgaggactctgcggtctatttctgtgcaagatcgcacggtaactattttgcttactggggccaagggactctggtcactgtctctgca

SEQ ID NO: 66 - protein, 117 aa, Artificial Sequence
  PA2LR3-P1G6 Heavy Chain Variable Region
EVQLQQSGAELVRPGSSVKISCKASGYAFSYYWMNWVKQRPGQGLEWIGQIYPGDGDTNYNGKFKGKATLTVDKSSSTAYMQLSSLTSEDSAVYFCARSHGNYFAYWGQGTLVTVSA

SEQ ID NO: 67 - DNA, 993 bp, Artificial Sequence; identical to SEQ ID NO: 3
  PA2LR3-P1G6 Heavy Chain Constant Region

SEQ ID NO: 68 - protein, 204 aa, Artificial Sequence
  PA2LR3-P1G6 Heavy Chain Constant Region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKC

SEQ ID NO: 69 - DNA, 324 bp, Artificial Sequence
  PA2LR3-P1G6 Light Chain Variable Region
gacattgttctctcccagtctccagcaatcatgtctgcatctctaggggaacgggtcaccatgacctgcactgccagctcaagtgtaagttccagttacttgcactggtaccagcagaagccaggatcctcccccaaactctggatttatagcacatccaacctggcttctggagtcccagctcgcttcagtggcagtgggtctgggacctcttactctctcacaatcagccgaatggaggctgaagatgctgccacttattactgccagcagtggagtagttacccactcacgttcggtgctgggaccaagctggagctgaaa

SEQ ID NO: 70 - protein, 108 aa, Artificial Sequence
  PA2LR3-P1G6 Light Chain Variable Region
DIVLSQSPAIMSASLGERVTMTCTASSSVSSSYLHWYQQKPGSSPKLWIYSTSNLASGVPARFSGSGSGTSYSLTISRMEAEDAATYYCQQWSSYPLTFGAGTKLELK

SEQ ID NO: 71 - DNA, 324 bp, Artificial Sequence; identical to SEQ ID NO: 7
  PA2LR3-P1G6 Light Chain Constant Region

SEQ ID NO: 72 - protein, 107 aa, Artificial Sequence; identical to SEQ ID NO: 8
  PA2LR3-P1G6 Light Chain Constant Region

SEQ ID NO: 73 - DNA, 351 bp, Artificial Sequence
  PA2LR3-P1H4 Heavy Chain Variable Region
gaggttcaactgcagcagtctggggctgagctggtgaggcctgggtcctcagtgaagatttcctgcaaggcttctggctatgtattcggtaactactggatgaactgggtgaagcagaggcctggacagggtcttgagtggattggacagatttatcctggagatggtgatactaactacaatgggaagttcaaaggtaaagccacactgactgcagacaaatcctccagcacagcctacatgcagctcagcagcctgacatctgaggactctgcggtctatttctgtgcaagatcgcacggtaactattttccttactggggccaagggactctggtcactgtctctgca

SEQ ID NO: 74 - protein, 117 aa, Artificial Sequence
  PA2LR3-P1H4 Heavy Chain Variable Region
EVQLQQSGAELVRPGSSVKISCKASGYVFGNYWMNWVKQRPGQGLEWIGQIYPGDGDTNYNGKFKGKATLTADKSSSTAYMQLSSLTSEDSAVYFCARSHGNYFPYWGQGTLVTVSA

SEQ ID NO: 75 - DNA, 993 bp, Artificial Sequence; identical to SEQ ID NO: 3
  PA2LR3-P1H4 Heavy Chain Constant Region

SEQ ID NO: 76 - protein, 204 aa, Artificial Sequence; identical to SEQ ID NO: 68
  PA2LR3-P1H4 Heavy Chain Constant Region

SEQ ID NO: 77 - DNA, 324 bp, Artificial Sequence
  PA2LR3-P1H4 Light Chain Variable Region
caaattgttctcactcagtctccagcaatcatgtctgcatctctaggggaacgggtcaccatgacctgcactgccagctcaagtgtaagttccagttacttgcactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgtcaacagtggagtagttacccactcacgttcggtgctgggaccaagctggagctgaaa

SEQ ID NO: 78 - protein, 108 aa, Artificial Sequence
  PA2LR3-P1H4 Light Chain Variable Region
QIVLTQSPAIMSASLGERVTMTCTASSSVSSSYLHWYQQKPGSSPKLWIYSTSNLASGVPARFSGSGSGTSYSLTISSMEAEDAATYYCQQWSSYPLTFGAGTKLELK

SEQ ID NO: 79 - DNA, 324 bp, Artificial Sequence; identical to SEQ ID NO: 7
  PA2LR3-P1H4 Light Chain Constant Region

SEQ ID NO: 80 - protein, 107 aa, Artificial Sequence; identical to SEQ ID NO: 8
  PA2LR3-P1H4 Light Chain Constant Region

SEQ ID NO: 81 - DNA, 351 bp, Artificial Sequence; identical to SEQ ID NO: 49
  PA2LR3-P2B8 Heavy Chain Variable Region

SEQ ID NO: 82 - protein, 117 aa, Artificial Sequence; identical to SEQ ID NO: 50
  PA2LR3-P2B8 Heavy Chain Variable Region

SEQ ID NO: 83 - DNA, 993 bp, Artificial Sequence; identical to SEQ ID NO: 3
  PA2LR3-P2B8 Heavy Chain Constant Region

SEQ ID NO: 84 - protein, 204 aa, Artificial Sequence; identical to SEQ ID NO: 68
  PA2LR3-P2B8 Heavy Chain Constant Region

SEQ ID NO: 85 - DNA, 324 bp, Artificial Sequence
  PA2LR3-P2B8 Light Chain Variable Region
gatattgtaatgacccagtctccagcaatcatgtctgcatctctaggggaacgggtcaccatgacctgcactgccagctcaagtataagttccagttacttgcactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgccaccagtatcatcgttcccccctcgcgttcggtgctgggaccaagctggagctgaaa

SEQ ID NO: 86 - protein, 108 aa, Artificial Sequence
  PA2LR3-P2B8 Light Chain Variable Region
DIVMTQSPAIMSASLGERVTMTCTASSSISSSYLHWYQQKPGSSPKLWIYSTSNLASGVPARFSGSGSGTSYSLTISSMEAEDAATYYCHQYHRSPLAFGAGTKLELK

SEQ ID NO: 87 - DNA, 324 bp, Artificial Sequence; identical to SEQ ID NO: 7
  PA2LR3-P2B8 Light Chain Constant Region

SEQ ID NO: 88 - protein, 107 aa, Artificial Sequence; identical to SEQ ID NO: 8
  PA2LR3-P2B8 Light Chain Constant Region

SEQ ID NO: 89 - DNA, 351 bp, Artificial Sequence
  PA2LR3-P2E5 Heavy Chain Variable Region
gaggttcagctgcagcagtctggggctgagctggtgaggcctgggtcctcagtgaagatttcctgcaaggcttctggctatgcattccgtgactactggatgaactgggtgaagcagaggcctggacagggtcttgagtggattggacagatttatcctggagatggtgctactaactacattggaaagttcaagggtaaagccacactgactgcagacaaatcctccagcacagcctacatgcagctcagcagcctgacatctgaggactctgcggtctatttctgtgcaagatcgcacggtaactattttccttactggggccacgggactctggtcactgtctctgca

SEQ ID NO: 90 - protein, 117 aa, Artificial Sequence
  PA2LR3-P2E5 Heavy Chain Variable Region
EVQLQQSGAELVRPGSSVKISCKASGYAFRDYWMNWVKQRPGQGLEWIGQIYPGDGATNYIGKFKGKATLTADKSSSTAYMQLSSLTSEDSAVYFCARSHGNYFPYWGHGTLVTVSA

SEQ ID NO: 91 - DNA, 993 bp, Artificial Sequence; identical to SEQ ID NO: 3
  PA2LR3-P2E5 Heavy Chain Constant Region

SEQ ID NO: 92 - protein, 204 aa, Artificial Sequence; identical to SEQ ID NO: 68
  PA2LR3-P2E5 Heavy Chain Constant Region

SEQ ID NO: 93 - DNA, 324 bp, Artificial Sequence
  PA2LR3-P2E5 Light Chain Variable Region
caaattgttctcactcagtctccagcaatcatgtctgcatctctaggggaacgggtcaccatgacctgcactgccagctcaagtgtaagttccagttacttgcactggtaccagcagaagccaggatcctcccccaaactctggatttatagcacatccaacctggcttctggagtcccagctcgcttcagtggcagtgggtctgggacctcttattctctcacaatcagcagcatggaggctgaagatgctgccacttattactgtcaacagtggagtagttacccactcacgttcggtgctgggaccaagctggagctgaaa

SEQ ID NO: 94 - protein, 108 aa, Artificial Sequence; identical to SEQ ID NO: 78
  PA2LR3-P2E5 Light Chain Variable Region

SEQ ID NO: 95 - DNA, 324 bp, Artificial Sequence; identical to SEQ ID NO: 7
  PA2LR3-P2E5 Light Chain Constant Region

SEQ ID NO: 96 - protein, 107 aa, Artificial Sequence; identical to SEQ ID NO: 8
  PA2LR3-P2E5 Light Chain Constant Region

SEQ ID NO: 97 - DNA, 351 bp, Artificial Sequence
  PA2LR3-P3A8 Heavy Chain Variable Region
gaggtccagcttcagcaatctggggctgagctggtgaggcctgggtcctcagtgaagatttcctgcaaggcttctggctatgcattcagttactactggatgaactgggtgaagcagaggcctggacagggtcttgagtggattggacagatttatcctggagatggtgatactaactacaatggaaaggtcaagggtaaagccacactgactgcagacaaatcctccagtacagcctacatgcagctcagcagcctaacatctgaggactctgcggtctatttctgtgcaagatcgcacggtaactattttgcttactggggccaagggactctggtcactgtctctgca

SEQ ID NO: 98 - protein, 117 aa, Artificial Sequence
  PA2LR3-P3A8 Heavy Chain Variable Region
EVQLQQSGAELVRPGSSVKISCKASGYAFSYYWMNWVKQRPGQGLEWIGQIYPGDGDTNYNGKVKGKATLTADKSSSTAYMQLSSLTSEDSAVYFCARSHGNYFAYWGQGTLVTVSA

SEQ ID NO: 99 - DNA, 993 bp, Artificial Sequence; identical to SEQ ID NO: 3
  PA2LR3-P3A8 Heavy Chain Constant Region

SEQ ID NO: 100 - protein, 204 aa, Artificial Sequence; identical to SEQ ID NO: 68
  PA2LR3-P3A8 Heavy Chain Constant Region

SEQ ID NO: 101 - DNA, 324 bp, Artificial Sequence
  PA2LR3-P3A8 Light Chain Variable Region
gacattgtgatgacccaatctccagcaatcatgtctgcatctctaggggaacgggtcaccatgacctgcactgccagctcaagtgtaagttccagttacttgcactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgccagcagtggagtagtaacccgctcacgttcggtgctgggaccaagctggagctgaaa

SEQ ID NO: 102 - protein, 108 aa, Artificial Sequence
  PA2LR3-P3A8 Light Chain Variable Region
DIVMTQSPAIMSASLGERVTMTCTASSSVSSSYLHWYQQKPGSSPKLWIYSTSNLASGVPARFSGSGSGTSYSLTISSMEAEDAATYYCQQWSSNPLTFGAGTKLELK

SEQ ID NO: 103 - DNA, 324 bp, Artificial Sequence; identical to SEQ ID NO: 7
  PA2LR3-P3A8 Light Chain Constant Region

SEQ ID NO: 104 - protein, 107 aa, Artificial Sequence; identical to SEQ ID NO: 8
  PA2LR3-P3A8 Light Chain Constant Region

SEQ ID NO: 105 - DNA, 351 bp, Artificial Sequence
  PA2LR3-P3B10 Heavy Chain Variable Region
gaggtgcagctgcagcagtctggggctgagctggtgaggcctgggtcctcagtgaagatttcctgcaaggcttctggctatgcattcagttactactggatgaactgggtgaagcagaggcctggacagggtcttgagtggattggacagatttatcctggagatggtgatactaactacaatggaaagttcaagggtaaagccacactgactgcagacaaatcctccagtacagcctacatgcagctcagcagcctaacatctgaggactctgcggtctatttctgtgcaagatcgcacggtaactattttccttactggggccaagggactctggtcactgtctctgca

SEQ ID NO: 106 - protein, 117 aa, Artificial Sequence
  PA2LR3-P3B10 Heavy Chain Variable Region
EVQLQQSGAELVRPGSSVKISCKASGYAFSYYWMNWVKQRPGQGLEWIGQIYPGDGDTNYNGKFKGKATLTADKSSSTAYMQLSSLTSEDSAVYFCARSHGNYFPYWGQGTLVTVSA

SEQ ID NO: 107 - DNA, 993 bp, Artificial Sequence; identical to SEQ ID NO: 3
  PA2LR3-P3B10 Heavy Chain Constant Region

SEQ ID NO: 108 - protein, 204 aa, Artificial Sequence; identical to SEQ ID NO: 68
  PA2LR3-P3B10 Heavy Chain Constant Region

SEQ ID NO: 109 - DNA, 324 bp, Artificial Sequence
  PA2LR3-P3B10 Light Chain Variable Region
gacattgtgataactcagtctccagcaatcgtgtctgcatctctaggggaacgggtcaccatgacctgcactgccagctcaagtgtaagttccagttacttgcactggtaccagcagaagccaggatcctcccccaaactctggatttatagcacatccaacctggcttctggagtcccagctcgcttcagtggcagtgggtctgggacctcttattctctcacaatcagcagcatggaggctgaagatgccgccacttattactgtcaacagtggagtagttacccactcacgttcggtgctgggaccaagctggaaatcaaa

SEQ ID NO: 110 - protein, 108 aa, Artificial Sequence
  PA2LR3-P3B10 Light Chain Variable Region
DIVITQSPAIVSASLGERVTMTCTASSSVSSSYLHWYQQKPGSSPKLWIYSTSNLASGVPARFSGSGSGTSYSLTISSMEAEDAATYYCQQWSSYPLTFGAGTKLEIK

SEQ ID NO: 111 - DNA, 324 bp, Artificial Sequence; identical to SEQ ID NO: 7
  PA2LR3-P3B10 Light Chain Constant Region

SEQ ID NO: 112 - protein, 107 aa, Artificial Sequence; identical to SEQ ID NO: 8
  PA2LR3-P3B10 Light Chain Constant Region

SEQ ID NO: 113 - DNA, 351 bp, Artificial Sequence
  PA2LR3-P3B8 Heavy Chain Variable Region
gaggtccagctgcagcagtctggggctgagctggtgaggcctgggtcctcagtgaagatttcctgcaaggcttctggctttgcattcagtaactactggatgaactgggtgaagcagaggcccggacagggtcttgagtggattggacagatttatcctggagatggtgatactaacttcaatggaaagttcaagggtagagccatactgactgcagacatatcctccaacacagcctacatgcagctcagcagcctaacatctgaggactctgcggtctatttctgtgcaagatcgcacggtaactattttccttactggggccaagggactctggtcactgtctctgca

SEQ ID NO: 114 - protein, 117 aa, Artificial Sequence; identical to SEQ ID NO: 42
  PA2LR3-P3B8 Heavy Chain Variable Region

SEQ ID NO: 115 - DNA, 993 bp, Artificial Sequence; identical to SEQ ID NO: 3
  PA2LR3-P3B8 Heavy Chain Constant Region

SEQ ID NO: 116 - protein, 204 aa, Artificial Sequence; identical to SEQ ID NO: 68
  PA2LR3-P3B8 Heavy Chain Constant Region

SEQ ID NO: 117 - DNA, 325 bp, Artificial Sequence
  PA2LR3-P3B8 Light Chain Variable Region
gatattgtgatgacacagtctccagcaatcatgtctgcatctctaggggaacgggtcaccatgacctgcactgccagctcaagtgtaagttccagttacttgcactggtaccagcagaagccaggatcctcccccaaactctggatttatggcacatccaacctggcttctggagtccctgttcgcttcagtggcagtggatctgggacctcttattctctcacaatcagcagcatggaggctgaagatgctgccacttattactgtcaacagtggagtagttacccactcacgttcggtgctgggaccaagctggagctgaaac

SEQ ID NO: 118 - protein, 108 aa, Artificial Sequence
  PA2LR3-P3B8 Light Chain Variable Region
DIVMTQSPAIMSASLGERVTMTCTASSSVSSSYLHWYQQKPGSSPKLWIYGTSNLASGVPVRFSGSGSGTSYSLTISSMEAEDAATYYCQQWSSYPLTFGAGTKLELK

SEQ ID NO: 119 - DNA, 324 bp, Artificial Sequence; identical to SEQ ID NO: 7
  PA2LR3-P3B8 Light Chain Constant Region

SEQ ID NO: 120 - protein, 107 aa, Artificial Sequence; identical to SEQ ID NO: 8
  PA2LR3-P3B8 Light Chain Constant Region

SEQ ID NO: 121 - DNA, 351 bp, Artificial Sequence
  PA2LR3-P3F8 Heavy Chain Variable Region
gaggttcagcttcagcagtctggggctgagctggtgaggcctgggtcctcagtgaagatttcctgcaaggcttctggctatgcattcagtaactactggatgaactgggtgaagcagaggcctggacagggtcttgagtggattggacagatttatcctggagatggtgatactaactacaatggaaatttcaagggtaaagccacactgactgcagacaaatcctccagcacagcctacatgcagctcagcagcctaacatctgaggactctgcggtctatttctgtgcaagatcgcacggtaactattttccttactggggccaagggactctggtcactgtctctgca

SEQ ID NO: 122 - protein, 117 aa, Artificial Sequence
  PA2LR3-P3F8 Heavy Chain Variable Region
EVQLQQSGAELVRPGSSVKISCKASGYAFSNYWMNWVKQRPGQGLEWIGQIYPGDGDTNYNGNFKGKATLTADKSSSTAYMQLSSLTSEDSAVYFCARSHGNYFPYWGQGTLVTVSA

SEQ ID NO: 123 - DNA, 993 bp, Artificial Sequence; identical to SEQ ID NO: 3
  PA2LR3-P3F8 Heavy Chain Constant Region

SEQ ID NO: 124 - protein, 204 aa, Artificial Sequence; identical to SEQ ID NO: 68
  PA2LR3-P3F8 Heavy Chain Constant Region

SEQ ID NO: 125 - DNA, 324 bp, Artificial Sequence
  PA2LR3-P3F8 Light Chain Variable Region
gatattgttctcacccagtctccagcaatcatgtctgcatctctaggggaacgggtcaccatgacctgcactgccagctcaagtgtaagttccagttacttgcactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgccagcagtggagtagttacccactcacgttcggtgctgggaccaagctggagttgaaa

SEQ ID NO: 126 - protein, 108 aa, Artificial Sequence
  PA2LR3-P3F8 Light Chain Variable Region
DIVLTQSPAIMSASLGERVTMTCTASSSVSSSYLHWYQQKPGSSPKLWIYSTSNLASGVPARFSGSGSGTSYSLTISSMEAEDAATYYCQQWSSYPLTFGAGTKLELK

SEQ ID NO: 127 - DNA, 324 bp, Artificial Sequence; identical to SEQ ID NO: 7
  PA2LR3-P3F8 Light Chain Constant Region

SEQ ID NO: 128 - protein, 107 aa, Artificial Sequence; identical to SEQ ID NO: 8
  PA2LR3-P3F8 Light Chain Constant Region

SEQ ID NO: 129 - DNA, 351 bp, Artificial Sequence; identical to SEQ ID NO: 105
  PA2LR3-P4C6 Heavy Chain Variable region

SEQ ID NO: 130 - protein, 117 aa, Artificial Sequence; identical to SEQ ID NO: 106
  PA2LR3-P4C6 Heavy Chain Variable region

SEQ ID NO: 131 - DNA, 993 bp, Artificial Sequence; identical to SEQ ID NO: 3
  PA2LR3-P4C6 Heavy Chain Constant region

SEQ ID NO: 132 - protein, 204 aa, Artificial Sequence; identical to SEQ ID NO: 68
  PA2LR3-P4C6 Heavy Chain Constant region

SEQ ID NO: 133 - DNA, 324 bp, Artificial Sequence; identical to SEQ ID NO: 109
  PA2LR3-P4C6 Light Chain Variable region

SEQ ID NO: 134 - protein, 108 aa, Artificial Sequence; identical to SEQ ID NO: 110
  PA2LR3-P4C6 Light Chain Variable region

SEQ ID NO: 135 - DNA, 324 bp, Artificial Sequence; identical to SEQ ID NO: 7
  PA2LR3-P4C6 Light Chain Constant region

SEQ ID NO: 136 - protein, 107 aa, Artificial Sequence; identical to SEQ ID NO: 8
  PA2LR3-P4C6 Light Chain Constant region

SEQ ID NO: 137 - DNA, 351 bp, Artificial Sequence
  PA2LR3-P4G10 Heavy Chain Variable region
gaggttcagctgcagcagtttggggctgagctggtgaggcctgggtcctcagtgaagatttcctgcaaggcttctggctatgcattcagttactactggatgaactgggtgaagcagaggcctggacagggtcttgagtggattggacagatttatcctggagatggtgatactaactacaatggaaagttcaagggtaaagccacactgactgcagacaaatcctccagtacagcctacatgcagctcagcagcctaacatctgaggactctgcggtctatttctgtgcaagatcgcacggtaactattttgcttactggggccaagggactctggtcactgtctctgca

SEQ ID NO: 138 - protein, 117 aa, Artificial Sequence
  PA2LR3-P4G10 Heavy Chain Variable region
EVQLQQFGAELVRPGSSVKISCKASGYAFSYYWMNWVKQRPGQGLEWIGQIYPGDGDTNYNGKFKGKATLTADKSSSTAYMQLSSLTSEDSAVYFCARSHGNYFAYWGQGTLVTVSA

SEQ ID NO: 139 - DNA, 993 bp, Artificial Sequence; identical to SEQ ID NO: 3
  PA2LR3-P4G10 Heavy Chain Constant region

SEQ ID NO: 140 - protein, 204 aa, Artificial Sequence; identical to SEQ ID NO: 68
  PA2LR3-P4G10 Heavy Chain Constant region

SEQ ID NO: 141 - DNA, 324 bp, Artificial Sequence
  PA2LR3-P4G10 Light Chain Variable region
gacattgttctcacccagtctccagcaatcatgtctgcatctctaggggaacgggtcaccatgacctgcactgccagctcaagtgtaagttccagttacttgcactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgccagcagtggagtagtaacccgctcacgttcggtgctgggaccaagctggagctgaaa

SEQ ID NO: 142 - protein, 108 aa, Artificial Sequence
  PA2LR3-P4G10 Light Chain Variable region
DIVLTQSPAIMSASLGERVTMTCTASSSVSSSYLHWYQQKPGSSPKLWIYSTSNLASGVPARFSGSGSGTSYSLTISSMEAEDAATYYCQQWSSNPLTFGAGTKLELK

SEQ ID NO: 143 - DNA, 324 bp, Artificial Sequence; identical to SEQ ID NO: 7
  PA2LR3-P4G10 Light Chain Constant region

SEQ ID NO: 144 - protein, 107 aa, Artificial Sequence; identical to SEQ ID NO: 8
  PA2LR3-P4G10 Light Chain Constant region

SEQ ID NO: 145 - DNA, 351 bp, Artificial Sequence
  PA2LR3-P5E7 Heavy Chain Variable region
gaggtccagctccagcagtctggggctgagctggtgaggcctgggtcctcagtgaagatttcctgcaaggcttctggctatgcattcagtaactactggatgaactgggtgaagcagaggcccggacagggtcttgagtggattggacagatttatcctggagatggtgatactaacttcaatggaaagttcaagggtagagccatactgactgcagacatatcctccaacacagcctacatgcagctcagcagcctaacatctgaggactctgcggtctatttctgtgcaagatcgcacggtaactattttccttactggggccaagggactctggtcactgtctctgca

SEQ ID NO: 146 - protein, 117 aa, Artificial Sequence
  PA2LR3-P5E7 Heavy Chain Variable region
EVQLQQSGAELVRPGSSVKISCKASGYAFSNYWMNWVKQRPGQGLEWIGQIYPGDGDTNFNGKFKGRAILTADISSNTAYMQLSSLTSEDSAVYFCARSHGNYFPYWGQGTLVTVSA

SEQ ID NO: 147 - DNA, 993 bp, Artificial Sequence; identical to SEQ ID NO: 3
  PA2LR3-P5E7 Heavy Chain Constant region

SEQ ID NO: 148 - protein, 204 aa, Artificial Sequence; identical to SEQ ID NO: 68
  PA2LR3-P5E7 Heavy Chain Constant region

SEQ ID NO: 149 - DNA, 324 bp, Artificial Sequence
  PA2LR3-P5E7 Light Chain Variable region
gacattgtgctcactcagtctccaaccaccatggctgcatctcccggggagaagatcactatcacctgcagtgccagctcaagtataagttccaattacttgcattggtatcagcagaagccaggattctcccctaaactcttgatttataggacatccactctggcttctggagtcccagctcgcttcagtggcagtgggtctgggacctcttactctctcacaatcagcagcatggaggctgaagatgctgccacttattactgccaccagtatcatcgttccccacacacgttcggctcggggaccaaactggaaatcaaa

SEQ ID NO: 150 - protein, 108 aa, Artificial Sequence
  PA2LR3-P5E7 Light Chain Variable region
DIVLTQSPTTMAASPGEKITITCSASSSISSNYLHWYQQKPGFSPKLLIYRTSTLASGVPARFSGSGSGTSYSLTISSMEAEDAATYYCHQYHRSPHTFGSGTKLEIK

SEQ ID NO: 151 - DNA, 324 bp, Artificial Sequence; identical to SEQ ID NO: 7
  PA2LR3-P5E7 Light Chain Constant region

SEQ ID NO: 152 - protein, 107 aa, Artificial Sequence; identical to SEQ ID NO: 8
  PA2LR3-P5E7 Light Chain Constant region

SEQ ID NO: 153 - DNA, 351 bp, Artificial Sequence
  PA2LR3-P6D7 Heavy Chain Variable region
gaggtgaagctggtggagtctgggggaggtttagtgcagcctggagggtccctgaaactctcctgtgcagcctctggattcactttcagtagctataccatgtcttgggttcgccagactccagagaagaggctggagtgggtcgcatacattagtaatggtggtggtagcacctactatccagacactgtaaagggccgattcaccatctccagagacaatgccaagaacaccctgtacctgcaaatgagcagtctgaagtctgaggacacggccatgtattactgtgcaagacatcgagatggtaactacgactactggggccaaggcaccacggtcaccgtctcctca

SEQ ID NO: 154 - protein, 117 aa, Artificial Sequence
  PA2LR3-P6D7 Heavy Chain Variable region
EVKLVESGGGLVQPGGSLKLSCAASGFTFSSYTMSWVRQTPEKRLEWVAYISNGGGSTYYPDTVKGRFTISRDNAKNTLYLQMSSLKSEDTAMYYCARHRDGNYDYWGQGTTVTVSS

SEQ ID NO: 155 - DNA, 993 bp, Artificial Sequence; identical to SEQ ID NO: 3
  PA2LR3-P6D7 Heavy Chain Constant region

SEQ ID NO: 156 - protein, 204 aa, Artificial Sequence; identical to SEQ ID NO: 68
  PA2LR3-P6D7 Heavy Chain Constant region

SEQ ID NO: 157 - DNA, 336 bp, Artificial Sequence
  PA2LR3-P6D7 Light Chain Variable region
gatattgtgataactcaggatgaactctccaaccctgtcacttctggagaatcagtttccatctcctgcaggtctagtaagagtctcctatataaggatgggaagacatacttgaattggtttctgcagagaccaggacaatctcctcagctcctgatctatttgatgtccacccgtgcatcaggagtctcagaccggtttagtggcagtgggtcaggaacagatttcaccctggaaatcagtaaagtgaaggctgaggatgtgggtgtgtattactgtcaacaacttgtagagtatccgctcacgttcggtgctgggacaaagttggaaataaaa

SEQ ID NO: 158 - protein, 112 aa, Artificial Sequence
  PA2LR3-P6D7 Light Chain Variable region
DIVITQDELSNPVTSGESVSISCRSSKSLLYKDGKTYLNWFLQRPGQSPQLLIYLMSTRASGVSDRFSGSGSGTDFTLEISKVKAEDVGVYYCQQLVEYPLTFGAGTKLEIK

SEQ ID NO: 159 - DNA, 324 bp, Artificial Sequence; identical to SEQ ID NO: 7
  PA2LR3-P6D7 Light Chain Constant region

SEQ ID NO: 160 - protein, 107 aa, Artificial Sequence; identical to SEQ ID NO: 8
  PA2LR3-P6D7 Light Chain Constant region

SEQ ID NO: 161 - DNA, 351 bp, Artificial Sequence
  PA2LR3-P1A7 Heavy Chain Variable region
ggggttcaactgcagcagtctggggctgagctggtgaggcctgggtcctcagtgaagatttcctgcaaggcttctggctttgcattcagttactactggatgaactgggtgaagcagaggcccggacagggtcttgagtggattggacagatttatcctggagatggtgatactaacttcaatggaaagttcaagggtagagccatactgactgcagacatatcctccaacacagcctacatgcagctcagcagcctaacatctgaggactctgcggtctatttctgtgcaagatcgcacggtaactattttccttactggggccgagggactctggtcactgtctctgca

SEQ ID NO: 162 - protein, 117 aa, Artificial Sequence
  PA2LR3-P1A7 Heavy Chain Variable region
GVQLQQSGAELVRPGSSVKISCKASGFAFSYYWMNWVKQRPGQGLEWIGQIYPGDGDTNFNGKFKGRAILTADISSNTAYMQLSSLTSEDSAVYFCARSHGNYFPYWGRGTLVTVSA

SEQ ID NO: 163 - DNA, 993 bp, Artificial Sequence; identical to SEQ ID NO: 3
  PA2LR3-P1A7 Heavy Chain Constant region

SEQ ID NO: 164 - protein, 204 aa, Artificial Sequence; identical to SEQ ID NO: 68
  PA2LR3-P1A7 Heavy Chain Constant region

SEQ ID NO: 165 - DNA, 324 bp, Artificial Sequence
  PA2LR3-P1A7 Light Chain Variable region
gatattgtgctaactcagtctccagcaatcatgtctgcatctctaggggaacgggtcaccatgacctgcactgccagctcaaatgtaagttccagttacttgcactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgccaccagtatcatcgttccccacccacgttcggtgctgggaccaagctggagctgaaa

SEQ ID NO: 166 - protein, 108 aa, Artificial Sequence
  PA2LR3-P1A7 Light Chain Variable region
DIVLTQSPAIMSASLGERVTMTCTASSNVSSSYLHWYQQKPGSSPKLWIYSTSNLASGVPARFSGSGSGTSYSLTISSMEAEDAATYYCHQYHRSPPTFGAGTKLELK

SEQ ID NO: 167 - DNA, 324 bp, Artificial Sequence; identical to SEQ ID NO: 7
  PA2LR3-P1A7 Light Chain Constant region

SEQ ID NO: 168 - protein, 107 aa, Artificial Sequence; identical to SEQ ID NO: 8
  PA2LR3-P1A7 Light Chain Constant region

SEQ ID NO: 169 - DNA, 363 bp, Artificial Sequence
  PA2R3-P1F1 Heavy Chain Variable region
gaggtccagctgcagcagtctggagctgagctgatgaagcctggggcctcagtgaagatatcctgcaaggctactggctacacattcagtagctactggatagagtgggtaaagcagaggcctggacatggccttgagtggattggagagattttacctggaagtggtagtactaactacaatgagaagttcaagggcaaggccacattcactgcagatacatcctccaacacagcctatatgcaactcagcagcctgacatctgaggactctgccgtctattactgtgcaagaggggcatggttactatcctactggtacttcgatgtctggggcgcggggacctcagtcaccgtctcctca

SEQ ID NO: 170 - protein, 121 aa, Artificial Sequence
  PA2R3-P1F1 Heavy Chain Variable region
EVQLQQSGAELMKPGASVKISCKATGYTFSSYWIEWVKQRPGHGLEWIGEILPGSGSTNYNEKFKGKATFTADTSSNTAYMQLSSLTSEDSAVYYCARGAWLLSYWYFDVWGAGTSVTVSS

SEQ ID NO: 171 - DNA, 993 bp, Artificial Sequence; identical to SEQ ID NO: 3
  PA2R3-P1F1 Heavy Chain Constant region

SEQ ID NO: 172 - protein, 204 aa, Artificial Sequence; identical to SEQ ID NO: 68
  PA2R3-P1F1 Heavy Chain Constant region

SEQ ID NO: 173 - DNA, 321 bp, Artificial Sequence
  PA2R3-P1F1 Light Chain Variable region
gacattcagatgatgcagtctacatcctccctgtctgcctctctgggagacagagtcaccatcagttgcagtgcaagtcagggcattagcaattatttaaactggtatcagcagaaaccagatggaactgttaaactcctgatctattacacatcaagtttacactcaggagtcccatcaaggttcagtggcagtggatcaggcacacagttttctctgaagatcaacagcctgcagcctgaagattttgggagttattactgtcaacatcattatggtactccgtacacgttcggaggggggaccaagctggagctgaaa

SEQ ID NO: 174 - protein, 107 aa, Artificial Sequence
  PA2R3-P1F1 Light Chain Variable region
DIQMMQSTSSLSASLGDRVTISCSASQGISNYLNWYQQKPDGTVKLLIYYTSSLHSGVPSRFSGSGSGTQFSLKINSLQPEDFGSYYCQHHYGTPYTFGGGTKLELK

SEQ ID NO: 175 - DNA, 324 bp, Artificial Sequence; identical to SEQ ID NO: 7
  PA2R3-P1F1 Light Chain Constant region

SEQ ID NO: 176 - protein, 107 aa, Artificial Sequence; identical to SEQ ID NO: 8
  PA2R3-P1F1 Light Chain Constant region

SEQ ID NO: 177 - DNA, 351 bp, Artificial Sequence
  PA13R3P3-A7 Heavy Chain Variable region
gaggtccagctccagcaatctggggctgagctgctgaggcctgggtcctcagtgaagatttcctgcaaggcttctggctatgaattcagttactactggatgaactgggtgaagcagaggcctggacagggtcttgagtggattggacagatttatcctggagatggtgaaactaagtacaatggaaagttcaagggtaaagccacactgactgcagacaaatcctccagcacagcctacatgcagctcagcagcctaacatctgaggactctgcggtctatttctgtgcaagatcccatggtaactaccttccttactggggccaagggactctggtcactgtctctgca

SEQ ID NO: 178 - protein, 117 aa, Artificial Sequence
  PA13R3P3-A7 Heavy Chain Variable region
EVQLQQSGAELLRPGSSVKISCKASGYEFSYYWMNWVKQRPGQGLEWIGQIYPGDGETKYNGKFKGKATLTADKSSSTAYMQLSSLTSEDSAVYFCARSHGNYLPYWGQGTLVTVSA

SEQ ID NO: 179 - DNA, 993 bp, Artificial Sequence; identical to SEQ ID NO: 3
  PA13R3P3-A7 Heavy Chain Constant region

SEQ ID NO: 180 - protein, 204 aa, Artificial Sequence; identical to SEQ ID NO: 68
  PA13R3P3-A7 Heavy Chain Constant region

SEQ ID NO: 181 - DNA, 324 bp, Artificial Sequence
  PA13R3P3-A7 Light Chain Variable region
gatattgttctcaaccagtctccagcaatcatgtctgcatctccaggggagaaggtcaccataacctgcactgccagctcaagtgtaagttccagttacttacactggtaccagcagaagccaggatcctcccccaaactctggatttatagcacatccaacctggcttctggagtccctgctcgcttcagtggcagtgggtctgggacctcttactctctcacaatcagcagtatggaggctgaagatgctgccacttattactgccagcagtatcatacttacccacccacgttcggctcggggacaaagttggaaataaaa

SEQ ID NO: 182 - protein, 108 aa, Artificial Sequence
  PA13R3P3-A7 Light Chain Variable region
DIVLNQSPAIMSASPGEKVTITCTASSSVSSSYLHWYQQKPGSSPKLWIYSTSNLASGVPARFSGSGSGTSYSLTISSMEAEDAATYYCQQYHTYPPTFGSGTKLEIK

SEQ ID NO: 183 - DNA, 324 bp, Artificial Sequence
  PA13R3P3-A7 Light Chain Constant region
cgaactgtggctgcaccatctgtcttcatcttcccgccatccgatgagcagttgaaatctggaactgcctctgttgtgtgcctgctgaataacttctatcccagagaggccaaagtacagtggaaggtggataacgccccccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagcttgcccgtcacaaagagcttcaacaggggagagtgttaa

SEQ ID NO: 184 - protein, 107 aa, Artificial Sequence
  PA13R3P3-A7 Light Chain Constant region
RTVAAPSVFIFPPSDEQLKSGTASVVCLLNNFYPREAKVQWKVDNAPQSGNSQESVTEQDSKDSTYSLSSTLTLSKADYEKHKVYACEVTHQGLSLPVTKSFNRGEC

SEQ ID NO: 185 - DNA, 351 bp, Artificial Sequence
  PA13R3P3-C3 Heavy Chain Variable region
gaggtccagctccagcaatctggggctgagctgctgaggcctgggtcctcagtgaagatttcctgcaaggcttctggctatgaattcagttactactggatgaactgggtgaagcagaggcctggacagggtcttgagtggattggacagatttatcctggagatggtgaaactaagtacaatggaaagttcaagggtaaagccacactgactgcagacaaatcctccagcacagcctacatgcagttcagcagcctaacatctgaggactctgcggtctatttctgtgcaagatcccatggtaaccaccttgcttactggggccaagggactctggtcactgtctctgca

SEQ ID NO: 186 - protein, 117 aa, Artificial Sequence
  PA13R3P3-C3 Heavy Chain Variable region
EVQLQQSGAELLRPGSSVKISCKASGYEFSYYWMNWVKQRPGQGLEWIGQIYPGDGETKYNGKFKGKATLTADKSSSTAYMQFSSLTSEDSAVYFCARSHGNHLAYWGQGTLVTVSA

SEQ ID NO: 187 - DNA, 993 bp, Artificial Sequence; identical to SEQ ID NO: 3
  PA13R3P3-C3 Heavy Chain Constant region

SEQ ID NO: 188 - protein, 204 aa, Artificial Sequence; identical to SEQ ID NO: 68
  PA13R3P3-C3 Heavy Chain Constant region

SEQ ID NO: 189 - DNA, 324 bp, Artificial Sequence
  PA13R3P3-C3 Light Chain Variable region
gatattgttctctcccagtctccagcaatcatgtctgcatctctaggggaacgggtcaccatgacctgcactgccagctcaagtgtaagctccagttacttacactggtaccagcagaagccaggatcctcccccaaactctgggtttatagcacatccaacctggcttctggagtcccagctcgcttcagcggcagtgggtctgggacctcttactctctcacaatcagcagcatggaggctgaagatgctgccacttattactgccaccagtatcatcgttccccacccacgttcggaggggggaccaaactggaaatcaaa

SEQ ID NO: 190 - protein, 108 aa, Artificial Sequence
  PA13R3P3-C3 Light Chain Variable region
DIVLSQSPAIMSASLGERVTMTCTASSSVSSSYLHWYQQKPGSSPKLWVYSTSNLASGVPARFSGSGSGTSYSLTISSMEAEDAATYYCHQYHRSPPTFGGGTKLEIK

SEQ ID NO: 191 - DNA, 324 bp, Artificial Sequence; identical to SEQ ID NO: 7
  PA13R3P3-C3 Light Chain Constant region

SEQ ID NO: 192 - protein, 107 aa, Artificial Sequence; identical to SEQ ID NO: 8
  PA13R3P3-C3 Light Chain Constant region

SEQ ID NO: 193 - DNA, 351 bp, Artificial Sequence
  PA13R3P3-D10 Heavy Chain Variable region
gaggtccagctccagcaatctggggctgagctgctgaggcctgggtcctcagtgaagatttcctgcaaggcttctggctatgaattcagttactactggatgaactgggtgaagcagaggcctggacagggtcttgagtggattggacagatttatcctggagatggtgaaactaagtacaatggaaagttcaagggtaaagccacactgactgcagacaaatcctccaacacagcctatatgcagctcagcagcctaacatctgaggactctgcggtctatttctgtacaagatcccatggtaactaccttccttactggggccaagggactctggtcactgtctctgca

SEQ ID NO: 194 - protein, 117 aa, Artificial Sequence
  PA13R3P3-D10 Heavy Chain Variable region
EVQLQQSGAELLRPGSSVKISCKASGYEFSYYWMNWVKQRPGQGLEWIGQIYPGDGETKYNGKFKGKATLTADKSSNTAYMQLSSLTSEDSAVYFCTRSHGNYLPYWGQGTLVTVSA

SEQ ID NO: 195 - DNA, 993 bp, Artificial Sequence; identical to SEQ ID NO: 3
  PA13R3P3-D10 Heavy Chain Constant region

SEQ ID NO: 196 - protein, 204 aa, Artificial Sequence; identical to SEQ ID NO: 68
  PA13R3P3-D10 Heavy Chain Constant region

SEQ ID NO: 197 - DNA, 324 bp, Artificial Sequence
  PA13R3P3-D10 Light Chain Variable region
gacattgttctctcccagtctccagcaatcatgtctgcatctccaggggaacgggtcaccatgacctgcaccgccagctcaagtgtaagttccagttacttacactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgccaccagtatcatcgttccccacccacgttcggaggggggaccaagctggagctgaaa

SEQ ID NO: 198 - protein, 108 aa, Artificial Sequence
  PA13R3P3-D10 Light Chain Variable region
DIVLSQSPAIMSASPGERVTMTCTASSSVSSSYLHWYQQKPGSSPKLWIYSTSNLASGVPARFSGSGSGTSYSLTISSMEAEDAATYYCHQYHRSPPTFGGGTKLELK

SEQ ID NO: 199 - DNA, 324 bp, Artificial Sequence; identical to SEQ ID NO: 7
  PA13R3P3-D10 Light Chain Constant region

SEQ ID NO: 200 - protein, 107 aa, Artificial Sequence; identical to SEQ ID NO: 8
  PA13R3P3-D10 Light Chain Constant region

SEQ ID NO: 201 - DNA, 351 bp, Artificial Sequence
  PA13R3P3-D11 Heavy Chain Variable region
gaggttcagctgcagcagtctggacctgagctgatgaagcctggggcttcagtgaagatttcctgcaaggcttctggctatgaattcagttactactggatgaactgggtgaagcagaggcctggacagggtcttgagtggattggacagatttatcctggagatggtgaaactaagtacaatggaaagttcaagggtaaagccacactgactgcagacaaatcctccagcacagcctacatgcagctcagcagcctaacatctgaggactctgcggtctatttctgtgcaagatcccatggtaactaccttccttcctggggccaagggactctggtcactgtctctgca

SEQ ID NO: 202 - protein, 117 aa, Artificial Sequence
  PA13R3P3-D11 Heavy Chain Variable region
EVQLQQSGPELMKPGASVKISCKASGYEFSYYWMNWVKQRPGQGLEWIGQIYPGDGETKYNGKFKGKATLTADKSSSTAYMQLSSLTSEDSAVYFCARSHGNYLPSWGQGTLVTVSA

SEQ ID NO: 203 - DNA, 993 bp, Artificial Sequence; identical to SEQ ID NO: 3
  PA13R3P3-D11 Heavy Chain Constant region

SEQ ID NO: 204 - protein, 204 aa, Artificial Sequence; identical to SEQ ID NO: 68
  PA13R3P3-D11 Heavy Chain Constant region

SEQ ID NO: 205 - DNA, 324 bp, Artificial Sequence
  PA13R3P3-D11 Light Chain Variable region
gacattgttctctcccagtctccagcaatcatgtccgcatctctaggggaacgggtcaccatgacctgcactgccagctcaagtgtaagttccagttacttacactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgccaccagtatcatcgttccccacccacgttcggaggggggaccaagctggagctgaaa

SEQ ID NO: 206 - protein, 108 aa, Artificial Sequence
  PA13R3P3-D11 Light Chain Variable region
DIVLSQSPAIMSASLGERVTMTCTASSSVSSSYLHWYQQKPGSSPKLWIYSTSNLASGVPARFSGSGSGTSYSLTISSMEAEDAATYYCHQYHRSPPTFGGGTKLELK

SEQ ID NO: 207 - DNA, 324 bp, Artificial Sequence; identical to SEQ ID NO: 7
  PA13R3P3-D11 Light Chain Constant region

SEQ ID NO: 208 - protein, 107 aa, Artificial Sequence; identical to SEQ ID NO: 8
  PA13R3P3-D11 Light Chain Constant region

SEQ ID NO: 209 - DNA, 351 bp, Artificial Sequence
  PA13R3P3-F6 Heavy Chain Variable region
gaggtccagctgcagcagtctggggctgagctgctgaggcctgggtcctcagtgaagatttcctgcaaggcttctggctatgaattcagttactactggatgaactgggtgaagcagaggcctggacagggtcttgagtggattggacagatttatcctggagatggtgaaactaagtacaatggaaagttcaagggtaaagccacactgactgcagacaaatcctccagcacagcctacatgcagctcagcagcctaacatctgaggactctgcggtctatttctgtgcaagatcccatggtaactacattccttactggggccaagggactctggtcactgtctctgca

SEQ ID NO: 210 - protein, 117 aa, Artificial Sequence
  PA13R3P3-F6 Heavy Chain Variable region
EVQLQQSGAELLRPGSSVKISCKASGYEFSYYWMNWVKQRPGQGLEWIGQIYPGDGETKYNGKFKGKATLTADKSSSTAYMQLSSLTSEDSAVYFCARSHGNYIPYWGQGTLVTVSA

SEQ ID NO: 211 - DNA, 993 bp, Artificial Sequence; identical to SEQ ID NO: 3
  PA13R3P3-F6 Heavy Chain Constant region

SEQ ID NO: 212 - protein, 204 aa, Artificial Sequence; identical to SEQ ID NO: 68
  PA13R3P3-F6 Heavy Chain Constant region

SEQ ID NO: 213 - DNA, 324 bp, Artificial Sequence
  PA13R3P3-F6 Light Chain Variable region
gatattgttctctcccagtctccagcaatcatgtctgcatctctaggggagcgtgtcaccatgacctgcactgccagctcaagtgtaagttccagttacttacactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgccaccagtatcatcgttccccacccacgttcggaggggggaccaagctggagctgaaa

SEQ ID NO: 214 - protein, 108 aa, Artificial Sequence; identical to SEQ ID NO: 206
  PA13R3P3-F6 Light Chain Variable region

SEQ ID NO: 215 - DNA, 324 bp, Artificial Sequence; identical to SEQ ID NO: 7
  PA13R3P3-F6 Light Chain Constant region

SEQ ID NO: 216 - protein, 107 aa, Artificial Sequence; identical to SEQ ID NO: 8
  PA13R3P3-F6 Light Chain Constant region

SEQ ID NO: 217 - DNA, 351 bp, Artificial Sequence
  PA13R3P4-C4 Heavy Chain Variable region
gaggttcaactgcagcagtctggggctgagctgctgaggcctgggtcctcagtgaagatttcctgcaaggcttctggctatgaattcaattactactggatgaactgggtgaagcagaggcctggacagggtcttgagtggattggacagatttatcctggagatggtgaaactaagtacaatggaaagttcaagggtaaagccacactgactgcagacaaatcctccagcacagcctacatgcagctcagcagcctaacatctgaggactctgcggtctatttctgtgcaagatcccatggtaactaccttccttactggggccaagggactctggtcactgtctctgca

SEQ ID NO: 218 - protein, 117 aa, Artificial Sequence
  PA13R3P4-C4 Heavy Chain Variable region
EVQLQQSGAELLRPGSSVKISCKASGYEFNYYWMNWVKQRPGQGLEWIGQIYPGDGETKYNGKFKGKATLTADKSSSTAYMQLSSLTSEDSAVYFCARSHGNYLPYWGQGTLVTVSA

SEQ ID NO: 219 - DNA, 993 bp, Artificial Sequence; identical to SEQ ID NO: 3
  PA13R3P4-C4 Heavy Chain Constant region

SEQ ID NO: 220 - protein, 204 aa, Artificial Sequence; identical to SEQ ID NO: 68
  PA13R3P4-C4 Heavy Chain Constant region

SEQ ID NO: 221 - DNA, 333 bp, Artificial Sequence
  PA13R3P4-C4 Light Chain Variable region
gacattgagctcacccaatctccagcttctttggctgtgtctctagggcagagggccaccatatcctgcagagccagtgaaagtgttgatagttatggcaatagttttatgcactggtaccagcagaaaccaggacagccacccaaactcctcatctatcttgcatccaacctagaatctggggtccctgccaggttcagtggcagtgggtctaggacagacttcaccctcaccattgatcctgtggaggctgatgatgctgcaacctattactgtcagcaaaataatgaggatcctccgacgttcggtggagggaccaagctggaaataaaa

SEQ ID NO: 222 - protein, 111 aa, Artificial Sequence
  PA13R3P4-C4 Light Chain Variable region
DIELTQSPASLAVSLGQRATISCRASESVDSYGNSFMHWYQQKPGQPPKLLIYLASNLESGVPARFSGSGSRTDFTLTIDPVEADDAATYYCQQNNEDPPTFGGGTKLEIK

SEQ ID NO: 223 - DNA, 324 bp, Artificial Sequence; identical to SEQ ID NO: 7
  PA13R3P4-C4 Light Chain Constant region

SEQ ID NO: 224 - protein, 107 aa, Artificial Sequence; identical to SEQ ID NO: 8
  PA13R3P4-C4 Light Chain Constant region

SEQ ID NO: 225 - DNA, 351 bp, Artificial Sequence
  PA13R3P4-F8 Heavy Chain Variable region
gaggtccagcttcagcagtctggggctgagctgctgaggcctgggtcctcagtgaagatttcctgcaaggcttctggctatgaattcagttactactggatgaactgggtgaagcagaggcctggacagggtcttgagtggattggacagatttatcctggagatggtgaaactaagtacaatggaaagttcaagggtaaagccacactgactgcagacaaatcctccagcacagcctacatgcagctcagcagcctaacatctgaggactctgcggtctatttctgtgcaagatcccatggtaactaccttccttactggggccaagggactctggtcactgtctctgca

SEQ ID NO: 226 - protein, 117 aa, Artificial Sequence; identical to SEQ ID NO: 178
  PA13R3P4-F8 Heavy Chain Variable region

SEQ ID NO: 227 - DNA, 993 bp, Artificial Sequence; identical to SEQ ID NO: 3
  PA13R3P4-F8 Heavy Chain Constant region

SEQ ID NO: 228 - protein, 204 aa, Artificial Sequence; identical to SEQ ID NO: 68
  PA13R3P4-F8 Heavy Chain Constant region

SEQ ID NO: 229 - DNA, 333 bp, Artificial Sequence
  PA13R3P4-F8 Light Chain Variable region
gacattgtgctcacccaatctccagcttctttggctgtgtctctagggcagagggccaccatatcctgcagagccagtgaaagtgttgatagttatggcaatagttttatgcactggtaccagcagaaaccaggacagccacccaaactcctcatctatcttgcatccaacctagaacctggggtccctgccaggttcagtggcagtgggtctaggacagacttcaccctcaccattgatcctgtggaggctgatgatgctgcaacctattactgtcagcaaaataatgaggatcctccgacgttcggtggagggaccaagctggagctgaaa

SEQ ID NO: 230 - protein, 111 aa, Artificial Sequence
  PA13R3P4-F8 Light Chain Variable region
DIVLTQSPASLAVSLGQRATISCRASESVDSYGNSFMHWYQQKPGQPPKLLIYLASNLEPGVPARFSGSGSRTDFTLTIDPVEADDAATYYCQQNNEDPPTFGGGTKLELK

SEQ ID NO: 231 - DNA, 324 bp, Artificial Sequence; identical to SEQ ID NO: 7
  PA13R3P4-F8 Light Chain Constant region

SEQ ID NO: 232 - protein, 107 aa, Artificial Sequence; identical to SEQ ID NO: 8
  PA13R3P4-F8 Light Chain Constant region

SEQ ID NO: 233 - DNA, 351 bp, Artificial Sequence
  PA13R3P4-G11 Heavy Chain Variable region
gaggtgcagctccagcagtctggggctgagctgctgaggcctgggtcctcagtgaagatttcctgcaaggcttctggctatgaattcagttactactggatgaactgggtgaagcagaggcctggacagggtcttgagtggattggacagatttatcctggagatggtgaaactaagtacaatggaaagttcaagggtaaagccacactgactgcagacaaatcctccagcacagcctacatgcagctcagcagcctaacatctgaggactctgcggtctatttctgtgcaagatcccatggtaactaccttccttactggggccaagggactctggtcactgtctctgca

SEQ ID NO: 234 - protein, 117 aa, Artificial Sequence; identical to SEQ ID NO: 178
  PA13R3P4-G11 Heavy Chain Variable region

SEQ ID NO: 235 - DNA, 993 bp, Artificial Sequence; identical to SEQ ID NO: 3
  PA13R3P4-G11 Heavy Chain Constant region

SEQ ID NO: 236 - protein, 204 aa, Artificial Sequence; identical to SEQ ID NO: 68
  PA13R3P4-G11 Heavy Chain Constant region

SEQ ID NO: 237 - DNA, 330 bp, Artificial Sequence
  PA13R3P4-G11 Light Chain Variable region
gatattgtgttaacacagtctcctgcttccttagctgtgtctctggggcagagggccaccatctcatgcagggccagccaaagtgtcagtacatctcgctatagttatatgcactggtaccaacagaaaccaggacagccacccaaactcctcatcaagtatgcatccaacctagaatctggggtccctgccaggttcagtggcagtgggtctgggacagacttcaccctcaacatccaccctgtggaggaggaggatattgcaacatattactgtcagcacagttgggagattcccacgttcggctcggggaccaagctggagctgaaa

SEQ ID NO: 238 - protein, 110 aa, Artificial Sequence
  PA13R3P4-G11 Light Chain Variable region
DIVLTQSPASLAVSLGQRATISCRASQSVSTSRYSYMHWYQQKPGQPPKLLIKYASNLESGVPARFSGSGSGTDFTLNIHPVEEEDIATYYCQHSWEIPTFGSGTKLELK

SEQ ID NO: 239 - DNA, 324 bp, Artificial Sequence; identical to SEQ ID NO: 7
  PA13R3P4-G11 Light Chain Constant region

SEQ ID NO: 240 - protein, 107 aa, Artificial Sequence; identical to SEQ ID NO: 8
  PA13R3P4-G11 Light Chain Constant region

SEQ ID NO: 241 - DNA, 351 bp, Artificial Sequence
  PA13R3P4-H10 Heavy Chain Variable region
gaggttcaactgcagcagtctggggctgagctgctgaggcctgggtcctcagtgaagatttcctgcaaggcttctggctatgaattcagttactactggatgaactgggtgaagcagaggcctggacagggtcttgagtggattggacagatttatcctggagatggtgatactaacttcaatggaaagttcaagggtaaagccacactgactgcagacaaatcctccagcacagcctacatgcagctcagcagcctaacatctgaggactctgcggtctatttctgtgcaagatcccatggtaaccacctagcttactggggccaagggactctggtcactgtctctgca

SEQ ID NO: 242 - protein, 117 aa, Artificial Sequence
  PA13R3P4-H10 Heavy Chain Variable region
EVQLQQSGAELLRPGSSVKISCKASGYEFSYYWMNWVKQRPGQGLEWIGQIYPGDGDTNFNGKFKGKATLTADKSSSTAYMQLSSLTSEDSAVYFCARSHGNHLAYWGQGTLVTVSA

SEQ ID NO: 243 - DNA, 993 bp, Artificial Sequence; identical to SEQ ID NO: 3
  PA13R3P4-H10 Heavy Chain Constant region

SEQ ID NO: 244 - protein, 204 aa, Artificial Sequence; identical to SEQ ID NO: 68
  PA13R3P4-H10 Heavy Chain Constant region

SEQ ID NO: 245 - DNA, 324 bp, Artificial Sequence
  PA13R3P4-H10 Light Chain Variable region
gatattgttctcaaccagtctccagcaatcatgtctgcatctctaggggaacgggtcaccatgacctgcactgccagctcaagtgtaagttccagttacttacactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgccaccagtatcatcgttccccacccacgttcggaggggggaccaagctggagctgaaa

SEQ ID NO: 246 - protein, 108 aa, Artificial Sequence
  PA13R3P4-H10 Light Chain Variable region
DIVLNQSPAIMSASLGERVTMTCTASSSVSSSYLHWYQQKPGSSPKLWIYSTSNLASGVPARFSGSGSGTSYSLTISSMEAEDAATYYCHQYHRSPPTFGGGTKLELK

SEQ ID NO: 247 - DNA, 324 bp, Artificial Sequence
  PA13R3P4-H10 Light Chain Constant region
cgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgtgaagtcacccatcagggcctgagcttgcccgtcacaaagagcttcaacaggggagagtgttaa

SEQ ID NO: 248 - protein, 107 aa, Artificial Sequence; identical to SEQ ID NO: 8
  PA13R3P4-H10 Light Chain Constant region

SEQ ID NO: 249 - DNA, 351 bp, Artificial Sequence
  PA15R3P3-A6 Heavy Chain Variable region
gaggttcaactgcagcagtctggggctgagctgctgaggcctgggtcctcagtgaagatttcctgcaaggcttctggctatgaattcagttactactggatgaactgggtgaagcagaggcctggacagggtcttgagtggattggacagatttatcctggagatggtgaaactaagtacaatggaaagttcaagggtaaagccacactgactgcagacaaatcctccagcacagcctacatgcagctcagcagcctaacatctgaggactctgcggtctatttctgtgcaagatcccatggtaactaccttgcttactggggccaagggactctggtcactgtctctgca

SEQ ID NO: 250 - protein, 117 aa, Artificial Sequence
  PA15R3P3-A6 Heavy Chain Variable region
EVQLQQSGAELLRPGSSVKISCKASGYEFSYYWMNWVKQRPGQGLEWIGQIYPGDGETKYNGKFKGKATLTADKSSSTAYMQLSSLTSEDSAVYFCARSHGNYLAYWGQGTLVTVSA

SEQ ID NO: 251 - DNA, 993 bp, Artificial Sequence; identical to SEQ ID NO: 3
  PA15R3P3-A6 Heavy Chain Constant region

SEQ ID NO: 252 - protein, 204 aa, Artificial Sequence; identical to SEQ ID NO: 68
  PA15R3P3-A6 Heavy Chain Constant region

SEQ ID NO: 253 - DNA, 324 bp, Artificial Sequence
  PA15R3P3-A6 Light Chain Variable region
gatattgtaatgacccagtctccagcaatcatgtctgcatctctaggggaacgggtcaccatgacctgcactgccagctcaagtgtaagttccagttacttacactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgccaccagtatcatcgttccccacccacgttcggaggggggaccaagctggagctgaaa

SEQ ID NO: 254 - protein, 108 aa, Artificial Sequence
  PA15R3P3-A6 Light Chain Variable region
DIVMTQSPAIMSASLGERVTMTCTASSSVSSSYLHWYQQKPGSSPKLWIYSTSNLASGVPARFSGSGSGTSYSLTISSMEAEDAATYYCHQYHRSPPTFGGGTKLELK

SEQ ID NO: 255 - DNA, 324 bp, Artificial Sequence; identical to SEQ ID NO: 7
  PA15R3P3-A6 Light Chain Constant region

SEQ ID NO: 256 - protein, 107 aa, Artificial Sequence; identical to SEQ ID NO: 8
  PA15R3P3-A6 Light Chain Constant region

SEQ ID NO: 257 - DNA, 351 bp, Artificial Sequence
  PA15R3P3-A7 Heavy Chain Variable region
gaggttcagctgcagcagtctggacctgagctggtgaagcctgggtcttcagtgaagatttcctgcaaggcttctggctatgaattcagttactactggatgaactgggtgaagcagaggcctggacagggtcttgagtggattggacagatttatcctggagatggtgaaactaagtacaatggaaagttcaagggtaaagccacactgactgcagacaaatcctccagcacagcctacatgcagctcagcagcctaacatctgaggactctgcggtctatttctgtgcaagatcccatggtaaccaccttccttactggggccaagggactctggtcactgtctctgca

SEQ ID NO: 258 - protein, 117 aa, Artificial Sequence
  PA15R3P3-A7 Heavy Chain Variable region
EVQLQQSGPELVKPGSSVKISCKASGYEFSYYWMNWVKQRPGQGLEWIGQIYPGDGETKYNGKFKGKATLTADKSSSTAYMQLSSLTSEDSAVYFCARSHGNHLPYWGQGTLVTVSA

SEQ ID NO: 259 - DNA, 993 bp, Artificial Sequence; identical to SEQ ID NO: 3
  PA15R3P3-A7 Heavy Chain Constant region

SEQ ID NO: 260 - protein, 204 aa, Artificial Sequence; identical to SEQ ID NO: 68
  PA15R3P3-A7 Heavy Chain Constant region

SEQ ID NO: 261 - DNA, 324 bp, Artificial Sequence
  PA15R3P3-A7 Light Chain Variable region
gacattgttctcacccagtctccagcaatcatgtctgcatctctaggggaacgggtcaccctgacctgcactgccagctcaagtgtaagttccagttacttacactggtaccagcagaagccaggatcctcccccaaactctggatttatagcacttccaacctggcttctggagtcccagctcgcttcagtggcagtgggtctgggacctcttactctctcacaatcagcagcatggaggctgaagatgctgccacttattactgccaccagtatcatcgttccccacccacgttcggaggggggaccaagttggaaataaaa

SEQ ID NO: 262 - protein, 108 aa, Artificial Sequence
  PA15R3P3-A7 Light Chain Variable region
DIVLTQSPAIMSASLGERVTLTCTASSSVSSSYLHWYQQKPGSSPKLWIYSTSNLASGVPARFSGSGSGTSYSLTISSMEAEDAATYYCHQYHRSPPTFGGGTKLEIK

SEQ ID NO: 263 - DNA, 324 bp, Artificial Sequence; identical to SEQ ID NO: 7
  PA15R3P3-A7 Light Chain Constant region

SEQ ID NO: 264 - protein, 107 aa, Artificial Sequence; identical to SEQ ID NO: 8
  PA15R3P3-A7 Light Chain Constant region

SEQ ID NO: 265 - DNA, 351 bp, Artificial Sequence
  PA15R3P3-C9 Heavy Chain Variable region
gaggtccagctgcagcaatctggggctgagctgctgaggcctgggtcctcagtgaagatttcctgcaaggcttctggctatgaattcagttactactggatgaactgggtgaagcagaggcctggacagggtcttgagtggattggacagatttatcctggagatggtgaaactaagtacaatggaaagttcaagggtaaagccacactgactgcagacaaatcctccaacacagcctatatgcagctcagcagcctaacatctgaggactctgcggtctatttctgtgcaagatcccatggtaactaccttccttactggggccaagggactctggtcactgtctctgca

SEQ ID NO: 266 - protein, 117 aa, Artificial Sequence
  PA15R3P3-C9 Heavy Chain Variable region
EVQLQQSGAELLRPGSSVKISCKASGYEFSYYWMNWVKQRPGQGLEWIGQIYPGDGETKYNGKFKGKATLTADKSSNTAYMQLSSLTSEDSAVYFCARSHGNYLPYWGQGTLVTVSA

SEQ ID NO: 267 - DNA, 993 bp, Artificial Sequence; identical to SEQ ID NO: 3
  PA15R3P3-C9 Heavy Chain Constant region

SEQ ID NO: 268 - protein, 204 aa, Artificial Sequence; identical to SEQ ID NO: 68
  PA15R3P3-C9 Heavy Chain Constant region

SEQ ID NO: 269 - DNA, 324 bp, Artificial Sequence
  PA15R3P3-C9 Light Chain Variable region
ggcattctgatgacccagtctccagcaatcatgtctgcatctctaggggaacgggtcaccatgacctgcactgccagctcaagtataagttccaattacttgcattggtatcagcagaagccaggattctcccctaaactcttgatttataggacatccaatctggcttctggagtcccagctcgcttcagtggcagtgggtctgggacctcttactctctcacaatcagcagcatggaggctgaagatgctgccacttattactgccaccagtttcatcgttccccacccacgttcggaggggggaccaagctggagctgaaa

SEQ ID NO: 270 - protein, 108 aa, Artificial Sequence
  PA15R3P3-C9 Light Chain Variable region
GILMTQSPAIMSASLGERVTMTCTASSSISSNYLHWYQQKPGFSPKLLIYRTSNLASGVPARFSGSGSGTSYSLTISSMEAEDAATYYCHQFHRSPPTFGGGTKLELK

SEQ ID NO: 271 - DNA, 324 bp, Artificial Sequence; identical to SEQ ID NO: 7
  PA15R3P3-C9 Light Chain Constant region

SEQ ID NO: 272 - protein, 107 aa, Artificial Sequence; identical to SEQ ID NO: 8
  PA15R3P3-C9 Light Chain Constant region

SEQ ID NO: 273 - DNA, 351 bp, Artificial Sequence; identical to SEQ ID NO: 25
  PA16R3-P2G6 Heavy Chain Variable region

SEQ ID NO: 274 - protein, 117 aa, Artificial Sequence; identical to SEQ ID NO: 26
  PA16R3-P2G6 Heavy Chain Variable region

SEQ ID NO: 275 - DNA, 993 bp, Artificial Sequence; identical to SEQ ID NO: 3
  PA16R3-P2G6 Heavy Chain Constant region

SEQ ID NO: 276 - protein, 204 aa, Artificial Sequence; identical to SEQ ID NO: 68
  PA16R3-P2G6 Heavy Chain Constant region

SEQ ID NO: 277 - DNA, 324 bp, Artificial Sequence
  PA16R3-P2G6 Light Chain Variable region
gatattgagctgacccaatctccagcaatcatgtctgcatctctaggggaacgggtcaccatgacctgcactgccagctcaagtgtaagttccagttacttgcactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttatttctgccagcagtggagtagtttcccgctcacgttcggtggagggaccaagctggagctgaaa

SEQ ID NO: 278 - protein, 108 aa, Artificial Sequence
  PA16R3-P2G6 Light Chain Variable region
DIELTQSPAIMSASLGERVTMTCTASSSVSSSYLHWYQQKPGSSPKLWIYSTSNLASGVPARFSGSGSGTSYSLTISSMEAEDAATYFCQQWSSFPLTFGGGTKLELK

SEQ ID NO: 279 - DNA, 324 bp, Artificial Sequence; identical to SEQ ID NO: 7
  PA16R3-P2G6 Light Chain Constant region

SEQ ID NO: 280 - protein, 107 aa, Artificial Sequence; identical to SEQ ID NO: 8
  PA16R3-P2G6 Light Chain Constant region

SEQ ID NO: 281 - DNA, 351 bp, Artificial Sequence; identical to SEQ ID NO: 25
  PA16R3-P1A6 Heavy Chain Variable region

SEQ ID NO: 282 - protein, 117 aa, Artificial Sequence; identical to SEQ ID NO: 26
  PA16R3-P1A6 Heavy Chain Variable region

SEQ ID NO: 283 - DNA, 993 bp, Artificial Sequence; identical to SEQ ID NO: 3
  PA16R3-P1A6 Heavy Chain Constant region

SEQ ID NO: 284 - protein, 204 aa, Artificial Sequence; identical to SEQ ID NO: 68
  PA16R3-P1A6 Heavy Chain Constant region

SEQ ID NO: 285 - DNA, 324 bp, Artificial Sequence
  PA16R3-P1A6 Light Chain Variable region
gatattgttctcaaccagtctccagcaatcatgtctgcatctctaggggaacgggtcaccatgacctgcactgccagctcaagtgtaagttccagttacttacactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgccaccagcatcatcgttccccacccacgttcggaggggggacaaagttggaaataaaa

SEQ ID NO: 286 - protein, 108 aa, Artificial Sequence
  PA16R3-P1A6 Light Chain Variable region
DIVLNQSPAIMSASLGERVTMTCTASSSVSSSYLHWYQQKPGSSPKLWIYSTSNLASGVPARFSGSGSGTSYSLTISSMEAEDAATYYCHQHHRSPPTFGGGTKLEIK

SEQ ID NO: 287 - DNA, 324 bp, Artificial Sequence; identical to SEQ ID NO: 7
  PA16R3-P1A6 Light Chain Constant region

SEQ ID NO: 288 - protein, 107 aa, Artificial Sequence; identical to SEQ ID NO: 8
  PA16R3-P1A6 Light Chain Constant region

SEQ ID NO: 289 - DNA, 351 bp, Artificial Sequence; identical to SEQ ID NO: 25
  PA16R3-P1B5 Heavy Chain Variable region

SEQ ID NO: 290 - protein, 117 aa, Artificial Sequence; identical to SEQ ID NO: 26
  PA16R3-P1B5 Heavy Chain Variable region

SEQ ID NO: 291 - DNA, 993 bp, Artificial Sequence; identical to SEQ ID NO: 3
  PA16R3-P1B5 Heavy Chain Constant region

SEQ ID NO: 292 - protein, 204 aa, Artificial Sequence; identical to SEQ ID NO: 68
  PA16R3-P1B5 Heavy Chain Constant region

SEQ ID NO: 293 - DNA, 334 bp, Artificial Sequence
  PA16R3-P1B5 Light Chain Variable region
gatattgtgctaacacagtctcctgcttccttagctgtatctctggggcagagggccaccatctcatgcagggccagcaaaagtgtcagtacatctggctatagttatatgcactggttccagcagaaaccaggacagccacccaaactcctcatcaagtatgcatccaacctagaatctggggtccctgccaggttcagtggcagtgggtctgggacagacttcaccctcaacatccatcctgtggaggaggaggatgctgcaacctattactgtcagcacggttgggagcttccattcacgttcggctcggggaccaagctggagctgaaac

SEQ ID NO: 294 - protein, 111 aa, Artificial Sequence
  PA16R3-P1B5 Light Chain Variable region
DIVLTQSPASLAVSLGQRATISCRASKSVSTSGYSYMHWFQQKPGQPPKLLIKYASNLESGVPARFSGSGSGTDFTLNIHPVEEEDAATYYCQHGWELPFTFGSGTKLELK

SEQ ID NO: 295 - DNA, 324 bp, Artificial Sequence; identical to SEQ ID NO: 7
  PA16R3-P1B5 Light Chain Constant region

SEQ ID NO: 296 - protein, 107 aa, Artificial Sequence; identical to SEQ ID NO: 8
  PA16R3-P1B5 Light Chain Constant region

SEQ ID NO: 297 - DNA, 351 bp, Artificial Sequence; identical to SEQ ID NO: 25
  PA16R3-P1E5 Heavy Chain Variable region

SEQ ID NO: 298 - protein, 117 aa, Artificial Sequence; identical to SEQ ID NO: 26
  PA16R3-P1E5 Heavy Chain Variable region

SEQ ID NO: 299 - DNA, 993 bp, Artificial Sequence; identical to SEQ ID NO: 3
  PA16R3-P1E5 Heavy Chain Constant region

SEQ ID NO: 300 - protein, 204 aa, Artificial Sequence; identical to SEQ ID NO: 68
  PA16R3-P1E5 Heavy Chain Constant region

SEQ ID NO: 301 - DNA, 324 bp, Artificial Sequence
  PA16R3-P1E5 Light Chain Variable region
gacattgtgatgacccagtctccagcaatcatgtctgcatctctaggggaacgggtcaccctgacctgcactgccagttcaagtgttagttccagttacttacactggtaccagcagaagccaggatcctcccccaaactctggatttatagcacttccaacctggcttctggagtcccagctcgcttcagtggcagtgggtctgggacctcttactctctcacaatcagcagcatggaggctgaagatgctgccacttattactgccaccagtatcatcgttccccacccacgttcggaggggggaccaagctggagctgaaa

SEQ ID NO: 302 - protein, 108 aa, Artificial Sequence
  PA16R3-P1E5 Light Chain Variable region
DIVMTQSPAIMSASLGERVTLTCTASSSVSSSYLHWYQQKPGSSPKLWIYSTSNLASGVPARFSGSGSGTSYSLTISSMEAEDAATYYCHQYHRSPPTFGGGTKLELK

SEQ ID NO: 303 - DNA, 324 bp, Artificial Sequence; identical to SEQ ID NO: 7
  PA16R3-P1E5 Light Chain Constant region

SEQ ID NO: 304 - protein, 107 aa, Artificial Sequence; identical to SEQ ID NO: 8
  PA16R3-P1E5 Light Chain Constant region

SEQ ID NO: 305 - DNA, 351 bp, Artificial Sequence; identical to SEQ ID NO: 25
  PA16R3-P1H5 Heavy Chain Variable region

SEQ ID NO: 306 - protein, 117 aa, Artificial Sequence; identical to SEQ ID NO: 26
  PA16R3-P1H5 Heavy Chain Variable region

SEQ ID NO: 307 - DNA, 993 bp, Artificial Sequence; identical to SEQ ID NO: 3
  PA16R3-P1H5 Heavy Chain Constant region

SEQ ID NO: 308 - protein, 204 aa, Artificial Sequence; identical to SEQ ID NO: 68
  PA16R3-P1H5 Heavy Chain Constant region

SEQ ID NO: 309 - DNA, 333 bp, Artificial Sequence
  PA16R3-P1H5 Light Chain Variable region
gatattgtgatgacccagtctccagcttctttggctgtgtctctagggcagagggccaccatatcctgcagagccagtgaaagtgttgatagttatggcaatagttttatgcactggtaccagcagaaagcaggacagccacccaaactcctcatctatcttgcatccaacctagaatctggggtccctgccaggttcagtggcagtgggtctaggacagacttcaccctcaccattgatcctgtggaggctgatgatgctgcaacctattactgtcaacaacattatagtactcctccgacgttcggtggagggacaaagttggaaataaaa

SEQ ID NO: 310 - protein, 111 aa, Artificial Sequence
  PA16R3-P1H5 Light Chain Variable region
DIVMTQSPASLAVSLGQRATISCRASESVDSYGNSFMHWYQQKAGQPPKLLIYLASNLESGVPARFSGSGSRTDFTLTIDPVEADDAATYYCQQHYSTPPTFGGGTKLEIK

SEQ ID NO: 311 - DNA, 324 bp, Artificial Sequence; identical to SEQ ID NO: 7
  PA16R3-P1H5 Light Chain Constant region

SEQ ID NO: 312 - protein, 107 aa, Artificial Sequence; identical to SEQ ID NO: 8
  PA16R3-P1H5 Light Chain Constant region

SEQ ID NO: 313 - DNA, 351 bp, Artificial Sequence; identical to SEQ ID NO: 25
  PA18R3-P1D8 Heavy Chain Variable region

SEQ ID NO: 314 - protein, 117 aa, Artificial Sequence; identical to SEQ ID NO: 26
  PA18R3-P1D8 Heavy Chain Variable region

SEQ ID NO: 315 - DNA, 993 bp, Artificial Sequence; identical to SEQ ID NO: 3
  PA18R3-P1D8 Heavy Chain Constant region

SEQ ID NO: 316 - protein, 204 aa, Artificial Sequence; identical to SEQ ID NO: 68
  PA18R3-P1D8 Heavy Chain Constant region

SEQ ID NO: 317 - DNA, 324 bp, Artificial Sequence
  PA18R3-P1D8 Light Chain Variable region
gatattgtgataactcagtctccagcaatcatgtctgcatctctaggggaacgggtcaccatgacctgcactgccagctcaagtgtaagttccagttacttacactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccatttattactgccagcagtggaattatcctcctatcacgttcggctcggggaccaagctggaaatcaaa

SEQ ID NO: 318 - protein, 108 aa, Artificial Sequence
  PA18R3-P1D8 Light Chain Variable region
DIVITQSPAIMSASLGERVTMTCTASSSVSSSYLHWYQQKPGSSPKLWIYSTSNLASGVPARFSGSGSGTSYSLTISSMEAEDAAIYYCQQWNYPPITFGSGTKLEIK

SEQ ID NO: 319 - DNA, 324 bp, Artificial Sequence; identical to SEQ ID NO: 7
  PA18R3-P1D8 Light Chain Constant region

SEQ ID NO: 320 - protein, 107 aa, Artificial Sequence; identical to SEQ ID NO: 8
  PA18R3-P1D8 Light Chain Constant region

SEQ ID NO: 321 - DNA, 351 bp, Artificial Sequence; identical to SEQ ID NO: 25
  PA18R3-P1E5 Heavy Chain Variable region

SEQ ID NO: 322 - protein, 117 aa, Artificial Sequence; identical to SEQ ID NO: 26
  PA18R3-P1E5 Heavy Chain Variable region

SEQ ID NO: 323 - DNA, 993 bp, Artificial Sequence; identical to SEQ ID NO: 3
  PA18R3-P1E5 Heavy Chain Constant region

SEQ ID NO: 324 - protein, 204 aa, Artificial Sequence; identical to SEQ ID NO: 68
  PA18R3-P1E5 Heavy Chain Constant region

SEQ ID NO: 325 - DNA, 324 bp, Artificial Sequence
  PA18R3-P1E5 Light Chain Variable region
gacattgtaatgacccagtctccagcaatcatgtctgcatctccaggggagaaggtcaccataacctgcagtgccagctcaagtataagttccaattacttgcattggtatcagcagaagccaggattctcccctaaactcttgatttataggacatccaatctggcttctggagtcccagctcgcttcagtggcagtgggtctgggacctcttactctctcacaattggcaccatggaggctgaagatgttgccacttactactgccagcagggtagtagtataccattcacgttcggctcggggaccaagctggaaataaaa

SEQ ID NO: 326 - protein, 108 aa, Artificial Sequence
  PA18R3-P1E5 Light Chain Variable region
DIVMTQSPAIMSASPGEKVTITCSASSSISSNYLHWYQQKPGFSPKLLIYRTSNLASGVPARFSGSGSGTSYSLTIGTMEAEDVATYYCQQGSSIPFTFGSGTKLEIK

SEQ ID NO: 327 - DNA, 324 bp, Artificial Sequence; identical to SEQ ID NO: 7
  PA18R3-P1E5 Light Chain Constant region

SEQ ID NO: 328 - protein, 107 aa, Artificial Sequence; identical to SEQ ID NO: 8
  PA18R3-P1E5 Light Chain Constant region

SEQ ID NO: 329 - DNA, 351 bp, Artificial Sequence; identical to SEQ ID NO: 25
  PA18R3-P1H5 Heavy Chain Variable region

SEQ ID NO: 330 - protein, 117 aa, Artificial Sequence; identical to SEQ ID NO: 26
  PA18R3-P1H5 Heavy Chain Variable region

SEQ ID NO: 331 - DNA, 993 bp, Artificial Sequence; identical to SEQ ID NO: 3
  PA18R3-P1H5 Heavy Chain Constant region

SEQ ID NO: 332 - protein, 204 aa, Artificial Sequence; identical to SEQ ID NO: 68
  PA18R3-P1H5 Heavy Chain Constant region

SEQ ID NO: 333 - DNA, 321 bp, Artificial Sequence
  PA18R3-P1H5 Light Chain Variable region
gacattgttctcaaccagtctccagcaatcatgtctgcatctctaggggaacgggtcaccatgacctgcactgccagctcaagtgtaagttccagttacttgcactggtaccagcagaagccaggatcctcccccaaactctggatttatagcacatccaacctggcttctggagtcccagctcgcttcagtggcagtgggtctgggacctcttactctctcacaatcagcagcatggaggctgaagatgctgccacttattactgccaccagtatcatcgttcccacacgttcggaggggggaccaaactggaaatcaaa

SEQ ID NO: 334 - protein, 107 aa, Artificial Sequence
  PA18R3-P1H5 Light Chain Variable region
DIVLNQSPAIMSASLGERVTMTCTASSSVSSSYLHWYQQKPGSSPKLWIYSTSNLASGVPARFSGSGSGTSYSLTISSMEAEDAATYYCHQYHRSHTFGGGTKLEIK

SEQ ID NO: 335 - DNA, 324 bp, Artificial Sequence; identical to SEQ ID NO: 7
  PA18R3-P1H5 Light Chain Constant region

SEQ ID NO: 336 - protein, 107 aa, Artificial Sequence; identical to SEQ ID NO: 8
  PA18R3-P1H5 Light Chain Constant region

SEQ ID NO: 337 - protein, 108 aa, Artificial Sequence
  Humanized P1C4 light chain variable region
EIVLTQSPATLSLSPGERATLSCRASQSVSSSYLHWYQQKPGQAPRLLIYSTSNLASGIPARFSGSGSGTDFTLTISRLEPEDFAVYYCHQYHRSPPTFGQGTKVEIK

SEQ ID NO: 338 - protein, 215 aa, Artificial Sequence
  Humanized P1C4 full light chain
EIVLTQSPATLSLSPGERATLSCRASQSVSSSYLHWYQQKPGQAPRLLIYSTSNLASGIPARFSGSGSGTDFTLTISRLEPEDFAVYYCHQYHRSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 339 - protein, 117 aa, Artificial Sequence
  Humanized P1C4-H0 heavy chain variable region
QVQLVQSGAEVKKPGSSVKVSCKASGGTFSYYWMNWVRQAPGQGLEWMGQIYPGDGETKYAQKFQGRVTITADKSTSTAYMELSSLRSEDTAVYYCARSHGNYLPYWGQGTLVTVSS

SEQ ID NO: 340 - protein, 117 aa, Artificial Sequence
  Humanized P1C4-H2 heavy chain variable region
QVQLVQSGAEVKKPGSSVKVSCKASGYEFSYYWMNWVRQAPGQGLEWMGQIYPGDGETKYAQKFQGRVTITADKSTSTAYMELSSLRSEDTAVYYCARSHGNYLPYWGQGTLVTVSS

SEQ ID NO: 341 - protein, 117 aa, Artificial Sequence
  Humanized P1C4-H4 heavy chain variable region
QVQLVQSGAEVKKPGSSVKVSCKASGYEFSYYWMNWVRQAPGQGLEWMGQIYPGDGETKYNGKFQGRVTITADKSTSTAYMELSSLRSEDTAVYYCARSHGNYLPYWGQGTLVTVSS

SEQ ID NO: 342 - protein, 330 aa, Artificial Sequence [sequence omitted]

SEQ ID NO: 343 - protein, 444 aa, Artificial Sequence
  Humanized P1C4 H0 IgG2-4 Hybrid
QVQLVQSGAEVKKPGSSVKVSCKASGGTFSYYWMNWVRQAPGQGLEWMGQIYPGDGETKYAQKFQGRVTITADKSTSTAYMELSSLRSEDTAVYYCARSHGNYLPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 344 - protein, 443 aa, Artificial Sequence
  Humanized P1C4 H0 IgG2A330S/P331S
QVQLVQSGAEVKKPGSSVKVSCKASGGTFSYYWMNWVRQAPGQGLEWMGQIYPGDGETKYAQKFQGRVTITADKSTSTAYMELSSLRSEDTAVYYCARSHGNYLPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 345 - protein, 444 aa, Artificial Sequence
  Humanized P1C4 H0 IgG4S228P
QVQLVQSGAEVKKPGSSVKVSCKASGGTFSYYWMNWVRQAPGQGLEWMGQIYPGDGETKYAQKFQGRVTITADKSTSTAYMELSSLRSEDTAVYYCARSHGNYLPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 346 - protein, 444 aa, Artificial Sequence
  Humanized P1C4 H2 IgG2-4 Hybrid
QVQLVQSGAEVKKPGSSVKVSCKASGYEFSYYWMNWVRQAPGQGLEWMGQIYPGDGETKYAQKFQGRVTITADKSTSTAYMELSSLRSEDTAVYYCARSHGNYLPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 347 - protein, 443 aa, Artificial Sequence
  Humanized P1C4 H2 IgG2A330S/P331S
QVQLVQSGAEVKKPGSSVKVSCKASGYEFSYYWMNWVRQAPGQGLEWMGQIYPGDGETKYAQKFQGRVTITADKSTSTAYMELSSLRSEDTAVYYCARSHGNYLPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 348 - protein, 444 aa, Artificial Sequence
  Humanized P1C4 H2 IgG4S228P
QVQLVQSGAEVKKPGSSVKVSCKASGYEFSYYWMNWVRQAPGQGLEWMGQIYPGDGETKYAQKFQGRVTITADKSTSTAYMELSSLRSEDTAVYYCARSHGNYLPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 349 - protein, 444 aa, Artificial Sequence
  Humanized P1C4 H4 IgG2-4 Hybrid
QVQLVQSGAEVKKPGSSVKVSCKASGYEFSYYWMNWVRQAPGQGLEWMGQIYPGDGETKYNGKFQGRVTITADKSTSTAYMELSSLRSEDTAVYYCARSHGNYLPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 350 - protein, 443 aa, Artificial Sequence
  Humanized P1C4 H4 IgG2A330S/P331S
QVQLVQSGAEVKKPGSSVKVSCKASGYEFSYYWMNWVRQAPGQGLEWMGQIYPGDGETKYNGKFQGRVTITADKSTSTAYMELSSLRSEDTAVYYCARSHGNYLPYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 351 - protein, 444 aa, Artificial Sequence
  Humanized P1C4 H4 IgG4S228P
QVQLVQSGAEVKKPGSSVKVSCKASGYEFSYYWMNWVRQAPGQGLEWMGQIYPGDGETKYNGKFQGRVTITADKSTSTAYMELSSLRSEDTAVYYCARSHGNYLPYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 352 - protein, 5 aa, Mus sp.
YYWMN

SEQ ID NO: 353 - protein, 11 aa, Mus sp.
QIYPGDGETKY

SEQ ID NO: 354 - protein, 8 aa, Mus sp.
SHGNYLPY

SEQ ID NO: 355 - protein, 5 aa, Mus sp.
SSYLH

SEQ ID NO: 356 - protein, 7 aa, Mus sp.
STSNLAS

SEQ ID NO: 357 - protein, 10 aa, Mus sp.
HQYHRSPPTF

SEQ ID NO: 358 - protein, 451 aa, Artificial Sequence
  alemtuzumab monoclonal antibody
QVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 359 - protein, 451 aa, Artificial Sequence
  benralizumab monoclonal antibody
EVQLVQSGAEVKKPGASVKVSCKASGYTFTSYVIHWVRQRPGQGLAWMGYINPYNDGTKYNERFKGKVTITSDRSTSTVYMELSSLRSEDTAVYLCGREGIRYYGLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 360 - protein, 453 aa, Artificial Sequence
  bevacizumab monoclonal antibody
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 361 - protein, 455 aa, Artificial Sequence
  bimekizumab monoclonal antibody
EVQLVESGGGLVQPGGSLRLSCAASGFTFSDYNMAWVRQAPGKGLEWVATITYEGRNTYYRDSVKGRFTISRDNAKNSLYLQMNSLRAEDTAVYYCASPPQYYEGSIYRLWFAHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 362 - protein, 449 aa, Artificial Sequence
  cantuzumab ravtansine monoclonal antibody
QVQLVQSGAEVKKPGETVKISCKASDYTFTYYGMNWVKQAPGQGLKWMGWIDTTTGEPTYAQKFQGRIAFSLETSASTAYLQIKSLKSEDTATYFCARRGPYNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 363 - protein, 445 aa, Artificial Sequence
  codrituzumab monoclonal antibody
QVQLVQSGAEVKKPGASVKVSCKASGYTFTDYEMHWVRQAPGQGLEWMGALDPKTGDTAYSQKFKGRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 364 - protein, 447 aa, Artificial Sequence
  dalotuzumab monoclonal antibody
QVQLQESGPGLVKPSETLSLTCTVSGYSITGGYLWNWIRQPPGKGLEWIGYISYDGTNNYKPSLKDRVTISRDTSKNQFSLKLSSVTAADTAVYYCARYGRVFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 365 - protein, 391 aa, Artificial Sequence
  efalizumab monoclonal antibody
NQKFKDRFTISVDKSKNTLYLQMNSLRAEDTAVYYCARGIYFYGTTYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 366 - protein, 449 aa, Artificial Sequence
  elotuzumab monoclonal antibody
EVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 367 - protein, 449 aa, Artificial Sequence
  enavatuzumab monoclonal antibody
EVQLVESGGGLVQPGGSLRLSCAASGFTFSSYWMSWVRQAPGKGLEWVAEIRLKSDNYATHYAESVKGRFTISRDDSKNSLYLQMNSLRAEDTAVYYCTGYYADAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 368 - protein, 452 aa, Artificial Sequence
  enokizumab monoclonal antibody
QVQLVQSGAEVKKPGSSVKVSCKASGGTFSYYWIEWVRQAPGQGLEWMGEILPGSGTTNPNEKFKGRVTITADESTSTAYMELSSLRSEDTAVYYCARADYYGSDYVKFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 369 - protein, 446 aa, Artificial Sequence
  etrolizumab monoclonal antibody
EVQLVESGGGLVQPGGSLRLSCAASGFFITNNYWGWVRQAPGKGLEWVGYISYSGSTSYNPSLKSRFTISRDTSKNTFYLQMNSLRAEDTAVYYCARTGSSGYFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 370 - protein, 449 aa, Artificial Sequence
  farletuzumab monoclonal antibody
EVQLVESGGGVVQPGRSLRLSCSASGFTFSGYGLSWVRQAPGKGLEWVAMISSGGSYTYYADSVKGRFAISRDNAKNTLFLQMDSLRPEDTGVYFCARHGDDPAWFAYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 371 - protein, 448 aa, Artificial Sequence
  ficlatuzumab monoclonal antibody
QVQLVQPGAEVKKPGTSVKLSCKASGYTFTTYWMHWVRQAPGQGLEWIGEINPTNGHTNYNQKFQGRATLTVDKSTSTAYMELSSLRSEDTAVYYCARNYVGSIFDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 372 - protein, 449 aa, Artificial Sequence
  imgatuzumab monoclonal antibody
QVQLVQSGAEVKKPGSSVKVSCKASGFTFTDYKIHWVRQAPGQGLEWMGYFNPNSGYSTYAQKFQGRVTITADKSTSTAYMELSSLRSEDTAVYYCARLSPGGYYVMDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 373 - protein, 449 aa, Artificial Sequence
  itolizumab monoclonal antibody
EVQLVESGGGLVKPGGSLKLSCAASGFKFSRYAMSWVRQAPGKRLEWVATISSGGSYIYYPDSVKGRFTISRDNVKNTLYLQMSSLRSEDTAMYYCARRDYDLDYFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 374 - protein, 450 aa, Artificial Sequence
  lifastuzumab vedotin monoclonal antibody
EVQLVESGGGLVQPGGSLRLSCAASGFSFSDFAMSWVRQAPGKGLEWVATIGRVAFHTYYPDSMKGRFTISRDNSKNTLYLQMNSLRAEDTAVYYCARHRGFDVGHFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 375 - protein, 453 aa, Artificial Sequence
  ligelizumab monoclonal antibody
QVQLVQSGAEVMKPGSSVKVSCKASGYTFSWYWLEWVRQAPGHGLEWMGEIDPGTFTTNYNEKFKARVTFTADTSTSTAYMELSSLRSEDTAVYYCARFSHFSGSNYDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 376 - protein, 448 aa, Artificial Sequence
  lodelcizumab monoclonal antibody
QVQLVQSGAEVKKPGASVKVSCKASGYTFSTMYMSWVRQAPGQGLEWMGRIDPANEHTNYAQKFQGRVTMTRDTSISTAYMELSRLTSDDTAVYYCARSYYYYNMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 377 - protein, 448 aa, Artificial Sequence
  lorvotuzumab mertansine monoclonal antibody
QVQLVESGGGVVQPGRSLRLSCAASGFTFSSFGMHWVRQAPGKGLEWVAYISSGSFTIYYADSVKGRFTISRDNSKNTLYLQMNSLRAEDTAVYYCARMRKGYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 378 - protein, 449 aa, Artificial Sequence
  mogamulizumab monoclonal antibody
EVQLVESGGDLVQPGRSLRLSCAASGFIFSNYGMSWVRQAPGKGLEWVATISSASTYSYYPDSVKGRFTISRDNAKNSLYLQMNSLRVEDTALYYCGRHSDGNFAFGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 379 - protein, 450 aa, Artificial Sequence
  motavizumab monoclonal antibody
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 380 - protein, 449 aa, Artificial Sequence
  obinutuzumab monoclonal antibody
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 381 - protein, 450 aa, Artificial Sequence
  ocaratuzumab monoclonal antibody
EVQLVQSGAEVKKPGESLKISCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKIKDTLMISRTPEVTCVVVDVSHEDPEVKFNWYVDGVEVHNAKTKPREEQYNSTYRVVSVLTVLHQDWLNGKEYKCKVSNKALPAPIEKTISKQKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 382 - protein, 451 aa, Artificial Sequence
  omalizumab monoclonal antibody
EVQLVESGGGLVQPGGSLRLSCAVSGYSITSGYSWNWIRQAPGKGLEWVASITYDGSTNYNPSVKGRITISRDDSKNTFYLQMNSLRAEDTAVYYCARGSHYFGHWHFAVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 383 - protein, 453 aa, Artificial Sequence
  parsatuzumab monoclonal antibody
EVQLVESGGGLVQPGGSLRLSCAASGYTFIDYYMNWVRQAPGKGLEWVGDINLDNSGTHYNQKFKGRFTISRDKSKNTAYLQMNSLRAEDTAVYYCAREGVYHDYDDYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 384 - protein, 447 aa, Artificial Sequence
  pateclizumab monoclonal antibody
EVQLVESGGGLVQPGGSLRLSCAASGYTFTSYVIHWVRQAPGKGLEWVGYNNPYNAGTNYNEKFKGRFTISSDKSKNTAYLQMNSLRAEDTAVYYCSRPTMLPWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 385 - protein, 452 aa, Artificial Sequence
  perakizumab monoclonal antibody
EVQLVESGGGLVQPGGSLRLSCAASGFTFSDYTMLWVRQAPGKGLEWVAIIKSGGSYSYYPDSVKGRFTISRDNAKNSLYLQMNSLRAEDTAVYYCARDGDYGSSYGAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 386 - protein, 226 aa, Artificial Sequence
  pertuzumab monoclonal antibody
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 387 - protein, 447 aa, Artificial Sequence
  pidilizumab monoclonal antibody
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 388 - protein, 447 aa, Artificial Sequence
  quilizumab monoclonal antibody
EVQLVESGGGLVQPGGSLRLSCAASGFTFSDYGIAWVRQAPGKGLEWVAFISDLAYTIYYADTVTGRFTISRDNSKNTLYLQMNSLRAEDTAVYYCARDNWDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 389 - protein, 447 aa, Artificial Sequence
  rontalizumab monoclonal antibody
EVQLVESGGGLVQPGGSLRLSCATSGYTFTEYIIHWVRQAPGKGLEWVASINPDYDITNYNQRFKGRFTISLDKSKRTAYLQMNSLRAEDTAVYYCASWISDFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 390 - protein, 446 aa, Artificial Sequence
  sofituzumab vedotin monoclonal antibody
EVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 391 - protein, 442 aa, Artificial Sequence
  solanezumab monoclonal antibody
EVQLVESGGGLVQPGGSLRLSCAASGFTFSRYSMSWVRQAPGKGLELVAQINSVGNSTYYPDTVKGRFTISRDNAKNTLYLQMNSLRAEDTAVYYCASGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 392 - protein, 448 aa, Artificial Sequence
  suvizumab monoclonal antibody
QVQLVQSGAEVKKPGASVKVSCKASGYTFTNSWIGWFRQAPGQGLEWIGDIYPGGGYTNYNEIFKGKATMTADTSTNTAYMELSSLRSEDTAVYYCSRGIPGYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 393 - protein, 449 aa, Artificial Sequence
  teplizumab monoclonal antibody
QVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 394 - protein, 446 aa, Artificial Sequence
  tildrakizumab monoclonal antibody
QVQLVQSGAEVKKPGASVKVSCKASGYIFITYWMTWVRQAPGQGLEWMGQIFPASGSADYNEKFEGRVTMTTDTSTSTAYMELRSLRSDDTAVYYCARGGGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 395 - protein, 449 aa, Artificial Sequence
  tocilizumab monoclonal antibody
QVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 396 - protein, 450 aa, Artificial Sequence
  trastuzumab monoclonal antibody
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 397 - protein, 449 aa, Artificial Sequence
  trastuzumab emtansine monoclonal antibody
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 398 - protein, 454 aa, Artificial Sequence
  tregalizumab monoclonal antibody
EEQLVESGGGLVKPGGSLRLSCAASGFSFSDCRMYWLRQAPGKGLEWIGVISVKSENYGANYAESVRGRFTISRDDSKNTVYLQMNSLKTEDTAVYYCSASYYRYDVGAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 399 - protein, 451 aa, Artificial Sequence
  vedolizumab monoclonal antibody
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYAIDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 400 - protein, 448 aa, Artificial Sequence
  vorsetuzumab monoclonal antibody
QVQLVQSGAEVKKPGASVKVSCKASGYTFTNYGMNWVRQAPGQGLKWMGWINTYTGEPTYADAFKGRVTMTRDTSISTAYMELSRLRSDDTAVYYCARDYGDYGMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 401 - protein, 448 aa, Artificial Sequence; identical to SEQ ID NO: 400
  vorsetuzumab mafodotin monoclonal antibody

SEQ ID NO: 402 - protein, 449 aa, Artificial Sequence
  yttrium 90 Y clivatuzumab tetraxetan monoclonal antibody
QVQLQQSGAEVKKPGASVKVSCEASGYTFPSYVLHWVKQAPGQGLEWIGYINPYNDGTQYNEKFKGKATLTRDTSINTAYMELSRLRSDDTAVYYCARGFGGSYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 403 - protein, 448 aa, Artificial Sequence
  anrukinzumab monoclonal antibody
EVQLVESGGGLVQPGGSLRLSCAASGFTFISYAMSWVRQAPGKGLEWVASISSGGNTYYPDSVKGRFTISRDNAKNSLYLQMNSLRAEDTAVYYCARLDGYYFGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEALGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 404 - protein, 444 aa, Artificial Sequence
  dacetuzumab monoclonal antibody
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 405 - protein, 446 aa, Artificial Sequence
  daclizumab monoclonal antibody
QVQLVQSGAEVKKPGSSVKVSCKASGYTFTSYRMHWVRQAPGQGLEWIGYINPSTGYTEYNQKFKDKATITADESTNTAYMELSSLRSEDTAVYYCARGGGVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 406 - protein, 447 aa, Artificial Sequence
  etaracizumab monoclonal antibody
QVQLVESGGGVVQPGRSLRLSCAASGFTFSSYDMSWVRQAPGKGLEWVAKVSSGGGSTYYLDTVQGRFTISRDNSKNTLYLQMNSLRAEDTAVYYCARHLHGSFASWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 407 - protein, 450 aa, Artificial Sequence
  milatuzumab monoclonal antibody
QVQLQQSGSELKKPGASVKVSCKASGYTFTNYGVNWIKQAPGQGLQWMGWINPNTGEPTFDDDFKGRFAFSLDTSVSTAYLQISSLKADDTAVYFCSRSRGKNEAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 408 - protein, 443 aa, Artificial Sequence
  ozanezumab monoclonal antibody
QVQLVQSGAEVKKPGASVKVSCKASGYTFTSYWMHWVRQAPGQGLEWIGNINPSNGGTNYNEKFKSKATMTRDTSTSTAYMELSSLRSEDTAVYYCELMQGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 409 - protein, 450 aa, Artificial Sequence
  pinatuzumab vedotin monoclonal antibody
EVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 410 - protein, 447 aa, Artificial Sequence
  polatuzumab vedotin monoclonal antibody
EVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 411 - protein, 449 aa, Artificial Sequence
  tigatuzumab monoclonal antibody
EVQLVESGGGLVQPGGSLRLSCAASGFTFSSYVMSWVRQAPGKGLEWVATISSGGSYTYYPDSVKGRFTISRDNAKNTLYLQMNSLRAEDTAVYYCARRGDSMITTDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 412 - protein, 451 aa, Artificial Sequence
  veltuzumab monoclonal antibody
QVQLQQSGAEVKKPGSSVKVSCKASGYTFTSYNMHWVKQAPGQGLEWIGAIYPGNGDTSYNQKFKGKATLTADESTNTAYMELSSLRSEDTAFYYCARSTYYGGDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 413 - protein, 447 aa, Artificial Sequence
  abituzumab monoclonal antibody
QVQLQQSGGELAKPGASVKVSCKASGYTFSSFWMHWVRQAPGQGLEWIGYINPRSGYTEYNEIFRDKATMTTDTSTSTAYMELSSLRSEDTAVYYCASFLGRGAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVEPKSSDKTHTCPPCPAPPVAGPSVFLFPPKPKDTLMISRTPEVTCVVVDVSHEDPEVQFNWYVDGVEVHNAKTKPREEQAQSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 414 - protein, 444 aa, Artificial Sequence
  bococizumab monoclonal antibody
QVQLVQSGAEVKKPGASVKVSCKASGYTFTSYYMHWVRQAPGQGLEWMGEISPFGGRTNYNEKFKSRVTMTRDTSTSTVYMELSSLRSEDTAVYYCARERPLYASDLWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 415 - protein, 444 aa, Artificial Sequence
  demcizumab monoclonal antibody
QVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 416 - protein, 445 aa, Artificial Sequence
  gevokizumab monoclonal antibody
QVQLQESGPGLVKPSQTLSLTCSFSGFSLSTSGMGVGWIRQPSGKGLEWLAHIWWDGDESYNPSLKSRLTISKDTSKNQVSLKITSVTAADTAVYFCARNRYDPPWFVDWGQGTLVTVSSASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 417 - protein, 442 aa, Artificial Sequence
  ponezumab monoclonal antibody
QVQLVQSGAEVKKPGASVKVSCKASGYYTEAYYIHWVRQAPGQGLEWMGRIDPATGNTKYAPRLQDRVTMTRDTSTSTVYMELSSLRSEDTAVYYCASLYSLPVYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 418 - protein, 444 aa, Artificial Sequence
  ralpancizumab monoclonal antibody
QVQLVQSGAEVKKPGASVKVSCKASGYTFTSYYMHWVRQAPGQGLEWMGEIHPSGGRTNYNEKFKSRVTMTRDTSTSTVYMELSSLRSEDTAVYYCARERPLYASDLWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 419 - protein, 449 aa, Artificial Sequence
  romosozumab monoclonal antibody
EVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 420 - protein, 447 aa, Artificial Sequence
  tanezumab monoclonal antibody
QVQLQESGPGLVKPSETLSLTCTVSGFSLIGYDLNWIRQPPGKGLEWIGIIWGDGTTDYNSAVKSRVTISKDTSKNQFSLKLSSVTAADTAVYYCARGGYWYATSYYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 421 - protein, 444 aa, Artificial Sequence
  blosozumab monoclonal antibody
QVQLVQSGAEVKKPGASVKVSCKVSGFPIKDTFQHWVRQAPGKGLEWMGWSDPEIGDTEYASKFQGRVTMTEDTSTDTAYMELSSLRSEDTAVYYCATGDTTYKFDFWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 422 - protein, 448 aa, Artificial Sequence
  concizumab monoclonal antibody
EVQLVESGGGLVKPGGSLRLSCAASGFTFSNYAMSWVRQTPEKRLEWVATISRSGSYSYFPDSVQGRFTISRDNAKNSLYLQMNSLRAEDTAVYYCARLGGYDEGDAMDSWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 423 - protein, 438 aa, Artificial Sequence
  crenezumab monoclonal antibody
EVQLVESGGGLVQPGGSLRLSCAASGFTFSSYGMSWVRQAPGKGLELVASINSNGGSTYYPDSVKGRFTISRDNAKNSLYLQMNSLRAEDTAVYYCASGDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 424 - protein, 449 aa, Artificial Sequence
  ibalizumab monoclonal antibody
QVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 425 - protein, 445 aa, Artificial Sequence
  ixekizumab monoclonal antibody
QVQLVQSGAEVKKPGSSVKVSCKASGYSFTDYHIHWVRQAPGQGLEWMGVINPMYGTTDYNQRFKGRVTITADESTSTAYMELSSLRSEDTAVYYCARYDYFTGTGVYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 426 - protein, 445 aa, Artificial Sequence
  lebrikizumab monoclonal antibody
QVTLRESGPALVKPTQTLTLTCTVSGFSLSAYSVNWIRQPPGKALEWLAMIWGDGKIVYNSALKSRLTISKDTSKNQVVLTMTNMDPVDTATYYCAGDGYYPYAMDNWGQGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 427 - protein, 447 aa, Artificial Sequence
  olokizumab monoclonal antibody
EVQLVESGGGLVQPGGSLRLSCAASGFNFNDYFMNWVRQAPGKGLEWVAQMRNKNYQYGTYYAESLEGRFTISRDDSKNSLYLQMNSLKTEDTAVYYCARESYYGFTSYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 428 - protein, 447 aa, Artificial Sequence
  pembrolizumab monoclonal antibody
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 429 - protein, 443 aa, Artificial Sequence
  simtuzumab monoclonal antibody
QVQLVQSGAEVKKPGASVKVSCKASGYAFTYYLIEWVRQAPGQGLEWIGVINPGSGGTNYNEKFKGRATITADKSTSTAYMELSSLRSEDTAVYFCARNWMNFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 430 - protein, 451 aa, Artificial Sequence
  ulocuplumab monoclonal antibody
EVQLVESGGGLVQPGGSLRLSCAAAGFTFSSYSMNWVRQAPGKGLEWVSYISSRSRTIYYADSVKGRFTISRDNAKNSLYLQMNSLRDEDTAVYYCARDYGGQPPYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 431 - protein, 446 aa, Artificial Sequence
  vatelizumab monoclonal antibody
QVQLQESGPGLVKPSETLSLTCTVSGFSLTNYGIHWIRQPPGKGLEWLGVIWARGFTNYNSALMSRLTISKDNSKNQVSLKLSSVTAADTAVYYCARANDGVYYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 432 - protein, 442 aa, Artificial Sequence
  samalizumab monoclonal antibody
QVQLQQSGSELKKPGASVKISCKASGYSFTDYIILWVRQNPGKGLEWIGHIDPYYGSSNYNLKFKGRVTITADQSTTTAYMELSSLRSEDTAVYYCGRSKRDYFDYWGQGTTLTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 433 - protein, 326 aa, Artificial Sequence
  IgG2 heavy constant region
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 434 - protein, 327 aa, Artificial Sequence
  IgG4 heavy chain constant region
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 435 - protein, 327 aa, Artificial Sequence
  Hybrid IgG2/4 heavy chain constant region
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 436 - protein, 443 aa, Artificial Sequence; identical to SEQ ID NO: 347
  P1C4-H2-IgG2

SEQ ID NO: 437 - protein, 444 aa, Artificial Sequence; identical to SEQ ID NO: 348
  P1C4-H2-IgG4

SEQ ID NO: 438 - protein, 444 aa, Artificial Sequence; identical to SEQ ID NO: 346
  P1C4-H2-IgG2/4

SEQ ID NO: 439 - protein, 443 aa, Artificial Sequence; identical to SEQ ID NO: 350
  P1C4-H4-IgG2

SEQ ID NO: 440 - protein, 444 aa, Artificial Sequence; identical to SEQ ID NO: 351
  P1C4-H4-IgG4

SEQ ID NO: 441 - protein, 444 aa, Artificial Sequence; identical to SEQ ID NO: 349
  P1C4-H4-IgG2/4

SEQ ID NO: 442 - protein, 215 aa, Artificial Sequence; identical to SEQ ID NO: 338
  P1C4-Lc humanized

SEQ ID NO: 443 - protein, 5 aa, Artificial Sequence
  Heavy chain CDR1 sequence mut
HYWMN

SEQ ID NO: 444 - protein, 5 aa, Artificial Sequence
  Heavy chain CDR1 sequence mut
IYWMN

SEQ ID NO: 445 - protein, 5 aa, Artificial Sequence
  Heavy chain CDR1 sequence mut
WYWMN

SEQ ID NO: 446 - protein, 5 aa, Artificial Sequence
  Heavy chain CDR1 sequence mut
YFWMN

SEQ ID NO: 447 - protein, 5 aa, Artificial Sequence
  Heavy chain CDR1 sequence mut
YKWMN

SEQ ID NO: 448 - protein, 5 aa, Artificial Sequence
  Heavy chain CDR1 sequence mut
YNWMN

SEQ ID NO: 449 - protein, 5 aa, Artificial Sequence
  Heavy chain CDR1 sequence mut
YYAMN

SEQ ID NO: 450 - protein, 5 aa, Artificial Sequence
  Heavy chain CDR1 sequence mut
YYFMN

SEQ ID NO: 451 - protein, 5 aa, Artificial Sequence
  Heavy chain CDR1 sequence mut
YYWAN

SEQ ID NO: 452 - protein, 5 aa, Artificial Sequence
  Heavy chain CDR1 sequence mut
YYWEN

SEQ ID NO: 453 - protein, 5 aa, Artificial Sequence
  Heavy chain CDR1 sequence mut
YYWFN

SEQ ID NO: 454 - protein, 5 aa, Artificial Sequence
  Heavy chain CDR1 sequence mut
YYWLN

SEQ ID NO: 455 - protein, 5 aa, Artificial Sequence
  Heavy chain CDR1 sequence mut
YYWNN

SEQ ID NO: 456 - protein, 5 aa, Artificial Sequence
  Heavy chain CDR1 sequence mut
YYWQN

SEQ ID NO: 457 - protein, 5 aa, Artificial Sequence
  Heavy chain CDR1 sequence mut
YYWTN

SEQ ID NO: 458 - protein, 5 aa, Artificial Sequence
  Heavy chain CDR1 sequence mut
YYWVN

SEQ ID NO: 459 - protein, 5 aa, Artificial Sequence
  Heavy chain CDR1 sequence mut
YYWMI

SEQ ID NO: 460 - protein, 5 aa, Artificial Sequence
  Heavy chain CDR1 sequence mut
YYWMK

SEQ ID NO: 461 - protein, 5 aa, Artificial Sequence
  Heavy chain CDR1 sequence mut
YYWML

SEQ ID NO: 462 - protein, 5 aa, Artificial Sequence
  Heavy chain CDR1 sequence mut
YYWMS

SEQ ID NO: 463 - protein, 5 aa, Artificial Sequence
  Heavy chain CDR1 sequence mut
YYWMW

SEQ ID NO: 464 - protein, 11 aa, Artificial Sequence
  Heavy chain CDR2 sequence mut
DIYPGDGETKY

SEQ ID NO: 465 - protein, 11 aa, Artificial Sequence
  Heavy chain CDR2 sequence mut
EIYPGDGETKY

SEQ ID NO: 466 - protein, 11 aa, Artificial Sequence
  Heavy chain CDR2 sequence mut
QAYPGDGETKY

SEQ ID NO: 467 - protein, 11 aa, Artificial Sequence
  Heavy chain CDR2 sequence mut
QDYPGDGETKY

SEQ ID NO: 468 - protein, 11 aa, Artificial Sequence
  Heavy chain CDR2 sequence mut
QEYPGDGETKY

SEQ ID NO: 469 - protein, 11 aa, Artificial Sequence
  Heavy chain CDR2 sequence mut
QFYPGDGETKY

SEQ ID NO: 470 - protein, 11 aa, Artificial Sequence
  Heavy chain CDR2 sequence mut
QGYPGDGETKY

SEQ ID NO: 471 - protein, 11 aa, Artificial Sequence
  Heavy chain CDR2 sequence mut
QHYPGDGETKY

SEQ ID NO: 472 - protein, 11 aa, Artificial Sequence
  Heavy chain CDR2 sequence mut
QKYPGDGETKY

SEQ ID NO: 473 - protein, 11 aa, Artificial Sequence
  Heavy chain CDR2 sequence mut
QLYPGDGETKY

SEQ ID NO: 474 - protein, 11 aa, Artificial Sequence
  Heavy chain CDR2 sequence mut
QNYPGDGETKY

SEQ ID NO: 475 - protein, 11 aa, Artificial Sequence
  Heavy chain CDR2 sequence mut
QQYPGDGETKY

SEQ ID NO: 476 - protein, 11 aa, Artificial Sequence
  Heavy chain CDR2 sequence mut
QRYPGDGETKY

SEQ ID NO: 477 - protein, 11 aa, Artificial Sequence
  Heavy chain CDR2 sequence mut
QSYPGDGETKY

SEQ ID NO: 478 - protein, 11 aa, Artificial Sequence
  Heavy chain CDR2 sequence mut
QTYPGDGETKY

SEQ ID NO: 479 - protein, 11 aa, Artificial Sequence
  Heavy chain CDR2 sequence mut
QWYPGDGETKY

SEQ ID NO: 480 - protein, 11 aa, Artificial Sequence
  Heavy chain CDR2 sequence mut
QYYPGDGETKY

SEQ ID NO: 481 - protein, 11 aa, Artificial Sequence
  Heavy chain CDR2 sequence mut
QIFPGDGETKY

SEQ ID NO: 482 - protein, 11 aa, Artificial Sequence
  Heavy chain CDR2 sequence mut
QIYAGDGETKY

SEQ ID NO: 483 - protein, 11 aa, Artificial Sequence
  Heavy chain CDR2 sequence mut
QIYFGDGETKY

SEQ ID NO: 484 - protein, 11 aa, Artificial Sequence
  Heavy chain CDR2 sequence mut
QIYHGDGETKY

SEQ ID NO: 485 - protein, 11 aa, Artificial Sequence
  Heavy chain CDR2 sequence mut
QIYKGDGETKY

SEQ ID NO: 486 - protein, 11 aa, Artificial Sequence
  Heavy chain CDR2 sequence mut
QIYPADGETKY

SEQ ID NO: 487 - protein, 11 aa, Artificial Sequence
  Heavy chain CDR2 sequence mut
QIYPCDGETKY

SEQ ID NO: 488 - protein, 11 aa, Artificial Sequence
  Heavy chain CDR2 sequence mut
QIYPDDGETKY

SEQ ID NO: 489 - protein, 11 aa, Artificial Sequence
  Heavy chain CDR2 sequence mut
QIYPEDGETKY

SEQ ID NO: 490 - protein, 11 aa, Artificial Sequence
  Heavy chain CDR2 sequence mut
QIYPFDGETKY

SEQ ID NO: 491 - protein, 11 aa, Artificial Sequence
  Heavy chain CDR2 sequence mut
QIYPHDGETKY

SEQ ID NO: 492 - protein, 11 aa, Artificial Sequence
  Heavy chain CDR2 sequence mut
QIYPIDGETKY

SEQ ID NO: 493 - protein, 11 aa, Artificial Sequence
  Heavy chain CDR2 sequence mut
QIYPKDGETKY

SEQ ID NO: 494 - protein, 11 aa, Artificial Sequence
  Heavy chain CDR2 sequence mut
QIYPLDGETKY

SEQ ID NO: 495 - protein, 11 aa, Artificial Sequence
  Heavy chain CDR2 sequence mut
QIYPMDGETKY

SEQ ID NO: 496 - protein, 11 aa, Artificial Sequence
  Heavy chain CDR2 sequence mut
QIYPQDGETKY

SEQ ID NO: 497 - protein, 11 aa, Artificial Sequence
  Heavy chain CDR2 sequence mut
QIYPRDGETKY

SEQ ID NO: 498 - protein, 11 aa, Artificial Sequence
  Heavy chain CDR2 sequence mut
QIYPSDGETKY

SEQ ID NO: 499 - protein, 11 aa, Artificial Sequence
  Heavy chain CDR2 sequence mut
QIYPTDGETKY

SEQ ID NO: 500 - protein, 11 aa, Artificial Sequence
  Heavy chain CDR2 sequence mut
QIYPVDGETKY

SEQ ID NO: 501 - protein, 11 aa, Artificial Sequence
  Heavy chain CDR2 sequence mut
QIYPWDGETKY

SEQ ID NO: 502 - protein, 11 aa, Artificial Sequence
  Heavy chain CDR2 sequence mut
QIYPYDGETKY

SEQ ID NO: 503 - protein, 11 aa, Artificial Sequence
  Heavy chain CDR2 sequence mut
QIYPGIGETKY

SEQ ID NO: 504 - protein, 11 aa, Artificial Sequence
  Heavy chain CDR2 sequence mut
QIYPGLGETKY

SEQ ID NO: 505 - protein, 11 aa, Artificial Sequence
  Heavy chain CDR2 sequence mut
QIYPGMGETKY

SEQ ID NO: 506 - protein, 11 aa, Artificial Sequence
  Heavy chain CDR2 sequence mut
QIYPGNGETKY

SEQ ID NO: 507 - protein, 11 aa, Artificial Sequence
  Heavy chain CDR2 sequence mut
QIYPGPGETKY

SEQ ID NO: 508 - protein, 11 aa, Artificial Sequence
  Heavy chain CDR2 sequence mut
QIYPGQGETKY

SEQ ID NO: 509 - protein, 11 aa, Artificial Sequence
  Heavy chain CDR2 sequence mut
QIYPGVGETKY

SEQ ID NO: 510 - protein, 11 aa, Artificial Sequence
  Heavy chain CDR2 sequence mut
QIYPGWGETKY

SEQ ID NO: 511 - protein, 11 aa, Artificial Sequence
  Heavy chain CDR2 sequence mut
QIYPGYGETKY

SEQ ID NO: 512 - protein, 11 aa, Artificial Sequence
  Heavy chain CDR2 sequence mut
QIYPGDAETKY

SEQ ID NO: 513 - protein, 11 aa, Artificial Sequence
  Heavy chain CDR2 sequence mut
QIYPGDDETKY

SEQ ID NO: 514 - protein, 11 aa, Artificial Sequence
  Heavy chain CDR2 sequence mut
QIYPGDEETKY

SEQ ID NO: 515 - protein, 11 aa, Artificial Sequence
  Heavy chain CDR2 sequence mut
QIYPGDFETKY

SEQ ID NO: 516 - protein, 11 aa, Artificial Sequence
  Heavy chain CDR2 sequence mut
QIYPGDHETKY

SEQ ID NO: 517 - protein, 11 aa, Artificial Sequence
  Heavy chain CDR2 sequence mut
QIYPGDIETKY

SEQ ID NO: 518 - protein, 11 aa, Artificial Sequence
  Heavy chain CDR2 sequence mut
QIYPGDKETKY

SEQ ID NO: 519 - protein, 11 aa, Artificial Sequence
  Heavy chain CDR2 sequence mut
QIYPGDLETKY

SEQ ID NO: 520 - protein, 11 aa, Artificial Sequence
  Heavy chain CDR2 sequence mut
QIYPGDMETKY

SEQ ID NO: 521 - protein, 11 aa, Artificial Sequence
  Heavy chain CDR2 sequence mut
QIYPGDNETKY

SEQ ID NO: 522 - protein, 11 aa, Artificial Sequence
  Heavy chain CDR2 sequence mut
QIYPGDPETKY

SEQ ID NO: 523 - protein, 11 aa, Artificial Sequence
  Heavy chain CDR2 sequence mut
QIYPGDQETKY

SEQ ID NO: 524 - protein, 11 aa, Artificial Sequence
  Heavy chain CDR2 sequence mut
QIYPGDRETKY

SEQ ID NO: 525 - protein, 11 aa, Artificial Sequence
  Heavy chain CDR2 sequence mut
QIYPGDVETKY

SEQ ID NO: 526 - protein, 11 aa, Artificial Sequence
  Heavy chain CDR2 sequence mut
QIYPGDTETKY

SEQ ID NO: 527 - protein, 11 aa, Artificial Sequence
  Heavy chain CDR2 sequence mut
QIYPGDVETKY

SEQ ID NO: 528 - protein, 11 aa, Artificial Sequence
  Heavy chain CDR2 sequence mut
QIYPGDYETKY

SEQ ID NO: 529 - protein, 11 aa, Artificial Sequence
  Heavy chain CDR2 sequence mut
QIYPGDGATKY

SEQ ID NO: 530 - protein, 11 aa, Artificial Sequence
  Heavy chain CDR2 sequence mut
QIYPGDGDTKY

SEQ ID NO: 531 - protein, 11 aa, Artificial Sequence
  Heavy chain CDR2 sequence mut
QIYPGDGMTKY

SEQ ID NO: 532 - protein, 11 aa, Artificial Sequence
  Heavy chain CDR2 sequence mut
QIYPGDGQTKY

SEQ ID NO: 533 - protein, 11 aa, Artificial Sequence
  Heavy chain CDR2 sequence mut
QIYPGDGVTKY

SEQ ID NO: 534 - protein, 11 aa, Artificial Sequence
  Heavy chain CDR2 sequence mut
QIYPGDGYTKY

SEQ ID NO: 535 - protein, 11 aa, Artificial Sequence
  Heavy chain CDR2 sequence mut
QIYPGDGEAKY

SEQ ID NO: 536 - protein, 11 aa, Artificial Sequence
  Heavy chain CDR2 sequence mut
QIYPGDGEDKY

SEQ ID NO: 537 - protein, 11 aa, Artificial Sequence
  Heavy chain CDR2 sequence mut
QIYPGDGEEKY

SEQ ID NO: 538 - protein, 11 aa, Artificial Sequence
  Heavy chain CDR2 sequence mut
QIYPGDGEFKY

SEQ ID NO: 539 - protein, 11 aa, Artificial Sequence
  Heavy chain CDR2 sequence mut
QIYPGDGEGKY

SEQ ID NO: 540 - protein, 11 aa, Artificial Sequence
  Heavy chain CDR2 sequence mut
QIYPGDGEHKY

SEQ ID NO: 541 - protein, 11 aa, Artificial Sequence
  Heavy chain CDR2 sequence mut
QIYPGDGEIKY

SEQ ID NO: 542 - protein, 11 aa, Artificial Sequence
  Heavy chain CDR2 sequence mut
QIYPGDGEKKY

SEQ ID NO: 543 - protein, 11 aa, Artificial Sequence
  Heavy chain CDR2 sequence mut
QIYPGDGEQKY

SEQ ID NO: 544 - protein, 11 aa, Artificial Sequence
  Heavy chain CDR2 sequence mut
QIYPGDGERKY

SEQ ID NO: 545 - protein, 11 aa, Artificial Sequence
  Heavy chain CDR2 sequence mut
QIYPGDGESKY

SEQ ID NO: 546 - protein, 11 aa, Artificial Sequence
  Heavy chain CDR2 sequence mut
QIYPGDGETKY

SEQ ID NO: 547 - protein, 11 aa, Artificial Sequence
  Heavy chain CDR2 sequence mut
QIYPGDGEVKY

SEQ ID NO: 548 - protein, 11 aa, Artificial Sequence
  Heavy chain CDR2 sequence mut
QIYPGDGEYKY

SEQ ID NO: 549 - protein, 11 aa, Artificial Sequence
  Heavy chain CDR2 sequence mut
QIYPGDGETDY

SEQ ID NO: 550 - protein, 11 aa, Artificial Sequence
  Heavy chain CDR2 sequence mut
QIYPGDGETEY

SEQ ID NO: 551 - protein, 11 aa, Artificial Sequence
  Heavy chain CDR2 sequence mut
QIYPGDGETHY

SEQ ID NO: 552 - protein, 11 aa, Artificial Sequence
  Heavy chain CDR2 sequence mut
QIYPGDGETIY

SEQ ID NO: 553 - protein, 11 aa, Artificial Sequence
  Heavy chain CDR2 sequence mut
QIYPGDGETLY

SEQ ID NO: 554 - protein, 11 aa, Artificial Sequence
  Heavy chain CDR2 sequence mut
QIYPGDGETMY

SEQ ID NO: 555 - protein, 11 aa, Artificial Sequence
  Heavy chain CDR2 sequence mut
QIYPGDGETNY

SEQ ID NO: 556 - protein, 11 aa, Artificial Sequence
  Heavy chain CDR2 sequence mut
QIYPGDGETPY

SEQ ID NO: 557 - protein, 11 aa, Artificial Sequence
  Heavy chain CDR2 sequence mut
QIYPGDGETQY

SEQ ID NO: 558 - protein, 11 aa, Artificial Sequence
  Heavy chain CDR2 sequence mut
QIYPGDGETRY

SEQ ID NO: 559 - protein, 11 aa, Artificial Sequence
  Heavy chain CDR2 sequence mut
QIYPGDGETSY

SEQ ID NO: 560 - protein, 11 aa, Artificial Sequence
  Heavy chain CDR2 sequence mut
QIYPGDGETTY

SEQ ID NO: 561 - protein, 11 aa, Artificial Sequence
  Heavy chain CDR2 sequence mut
QIYPGDGETVY

SEQ ID NO: 562 - protein, 11 aa, Artificial Sequence
  Heavy chain CDR2 sequence mut
QIYPGDGETWY

SEQ ID NO: 563 - protein, 11 aa, Artificial Sequence
  Heavy chain CDR2 sequence mut
QIYPGDGETYY

SEQ ID NO: 564 - protein, 11 aa, Artificial Sequence
  Heavy chain CDR2 sequence mut
QIYPGDGETKC

SEQ ID NO: 565 - protein, 11 aa, Artificial Sequence
  Heavy chain CDR2 sequence mut
QIYPGDGETKD

SEQ ID NO: 566 - protein, 11 aa, Artificial Sequence
  Heavy chain CDR2 sequence mut
QIYPGDGETKE

SEQ ID NO: 567 - protein, 11 aa, Artificial Sequence
  Heavy chain CDR2 sequence mut
QIYPGDGETKF

SEQ ID NO: 568 - protein, 11 aa, Artificial Sequence
  Heavy chain CDR2 sequence mut
QIYPGDGETKG

SEQ ID NO: 569 - protein, 11 aa, Artificial Sequence
  Heavy chain CDR2 sequence mut
QIYPGDGETKH

SEQ ID NO: 570 - protein, 11 aa, Artificial Sequence
  Heavy chain CDR2 sequence mut
QIYPGDGETKI

SEQ ID NO: 571 - protein, 11 aa, Artificial Sequence
  Heavy chain CDR2 sequence mut
QIYPGDGETKL

SEQ ID NO: 572 - protein, 11 aa, Artificial Sequence
  Heavy chain CDR2 sequence mut
QIYPGDGETKN

SEQ ID NO: 573 - protein, 11 aa, Artificial Sequence
  Heavy chain CDR2 sequence mut
QIYPGDGETKP

SEQ ID NO: 574 - protein, 11 aa, Artificial Sequence
  Heavy chain CDR2 sequence mut
QIYPGDGETKQ

SEQ ID NO: 575 - protein, 11 aa, Artificial Sequence
  Heavy chain CDR2 sequence mut
QIYPGDGETKR

SEQ ID NO: 576 - protein, 11 aa, Artificial Sequence
  Heavy chain CDR2 sequence mut
QIYPGDGETKT

SEQ ID NO: 577 - protein, 11 aa, Artificial Sequence
  Heavy chain CDR2 sequence mut
QIYPGDGETKW

SEQ ID NO: 578 - protein, 8 aa, Artificial Sequence
  NHGNYLPY
NHGNYLPY

SEQ ID NO: 579 - protein, 8 aa, Artificial Sequence
  THGNYLPY
THGNYLPY

SEQ ID NO: 580 - protein, 8 aa, Artificial Sequence
  Heavy chain CDR3 sequence mut
YHGNYLPY

SEQ ID NO: 581 - protein, 8 aa, Artificial Sequence
  Heavy chain CDR3 sequence mut
SHGNALPY

SEQ ID NO: 582 - protein, 8 aa, Artificial Sequence
  Heavy chain CDR3 sequence mut
SHGNCLPY

SEQ ID NO: 583 - protein, 8 aa, Artificial Sequence
  Heavy chain CDR3 sequence mut
SHGNFLPY

SEQ ID NO: 584 - protein, 8 aa, Artificial Sequence
  Heavy chain CDR3 sequence mut
SHGNHLPY

SEQ ID NO: 585 - protein, 8 aa, Artificial Sequence
  Heavy chain CDR3 sequence mut
SHGNNLPY

SEQ ID NO: 586 - protein, 8 aa, Artificial Sequence
  Heavy chain CDR3 sequence mut
SHGNSLPY

SEQ ID NO: 587 - protein, 8 aa, Artificial Sequence
  Heavy chain CDR3 sequence mut
SHGNYDPY

SEQ ID NO: 588 - protein, 8 aa, Artificial Sequence
  Heavy chain CDR3 sequence mut
SHGNYEPY

SEQ ID NO: 589 - protein, 8 aa, Artificial Sequence
  Heavy chain CDR3 sequence mut
SHGNYFPY

SEQ ID NO: 590 - protein, 8 aa, Artificial Sequence
  Heavy chain CDR3 sequence mut
SHGNYGPY

SEQ ID NO: 591 - protein, 8 aa, Artificial Sequence
  Heavy chain CDR3 sequence mut
SHGNYHPY

SEQ ID NO: 592 - protein, 8 aa, Artificial Sequence
  Heavy chain CDR3 sequence mut
SHGNYIPY

SEQ ID NO: 593 - protein, 8 aa, Artificial Sequence
  Heavy chain CDR3 sequence mut
SHGNYKPY

SEQ ID NO: 594 - protein, 8 aa, Artificial Sequence
  Heavy chain CDR3 sequence mut
SHGNYMPY

SEQ ID NO: 595 - protein, 8 aa, Artificial Sequence
  Heavy chain CDR3 sequence mut
SHGNYNPY

SEQ ID NO: 596 - protein, 8 aa, Artificial Sequence
  Heavy chain CDR3 sequence mut
SHGNYQPY

SEQ ID NO: 597 - protein, 8 aa, Artificial Sequence
  Heavy chain CDR3 sequence mut
SHGNYSPY

SEQ ID NO: 598 - protein, 8 aa, Artificial Sequence
  Heavy chain CDR3 sequence mut
SHGNYWPY

SEQ ID NO: 599 - protein, 8 aa, Artificial Sequence
  Heavy chain CDR3 sequence mut
SHGNYYPY

SEQ ID NO: 600 - protein, 8 aa, Artificial Sequence
  Heavy chain CDR3 sequence mut
SHGNYLAY

SEQ ID NO: 601 - protein, 8 aa, Artificial Sequence
  Heavy chain CDR3 sequence mut
SHGNYLEY

SEQ ID NO: 602 - protein, 8 aa, Artificial Sequence
  Heavy chain CDR3 sequence mut
SHGNYLFY

SEQ ID NO: 603 - protein, 8 aa, Artificial Sequence
  Heavy chain CDR3 sequence mut
SHGNYLGY

SEQ ID NO: 604 - protein, 8 aa, Artificial Sequence
  Heavy chain CDR3 sequence mut
SHGNYLHY

SEQ ID NO: 605 - protein, 8 aa, Artificial Sequence
  Heavy chain CDR3 sequence mut
SHGNYLKY

SEQ ID NO: 606 - protein, 8 aa, Artificial Sequence
  Heavy chain CDR3 sequence mut
SHGNYLLY

SEQ ID NO: 607 - protein, 8 aa, Artificial Sequence
  Heavy chain CDR3 sequence mut
SHGNYLQY

SEQ ID NO: 608 - protein, 8 aa, Artificial Sequence
  Heavy chain CDR3 sequence mut
SHGNYLRY

SEQ ID NO: 609 - protein, 8 aa, Artificial Sequence
  Heavy chain CDR3 sequence mut
SHGNYLSY

SEQ ID NO: 610 - protein, 8 aa, Artificial Sequence
  Heavy chain CDR3 sequence mut
SHGNYLVY

SEQ ID NO: 611 - protein, 8 aa, Artificial Sequence
  Heavy chain CDR3 sequence mut
SHGNYLWY

SEQ ID NO: 612 - protein, 8 aa, Artificial Sequence
  Heavy chain CDR3 sequence mut
SHGNYLYY

SEQ ID NO: 613 - protein, 8 aa, Artificial Sequence
  Heavy chain CDR3 sequence mut
SHGNYLPA

SEQ ID NO: 614 - protein, 8 aa, Artificial Sequence
  Heavy chain CDR3 sequence mut
SHGNYLPD

SEQ ID NO: 615 - protein, 8 aa, Artificial Sequence
  Heavy chain CDR3 sequence mut
SHGNYLPE

SEQ ID NO: 616 - protein, 8 aa, Artificial Sequence
  Heavy chain CDR3 sequence mut
SHGNYLPF

SEQ ID NO: 617 - protein, 8 aa, Artificial Sequence
  Heavy chain CDR3 sequence mut
SHGNYLPG

SEQ ID NO: 618 - protein, 8 aa, Artificial Sequence
  Heavy chain CDR3 sequence mut
SHGNYLPH

SEQ ID NO: 619 - protein, 8 aa, Artificial Sequence
  Heavy chain CDR3 sequence mut
SHGNYLPI

SEQ ID NO: 620 - protein, 8 aa, Artificial Sequence
  Heavy chain CDR3 sequence mut
SHGNYLPK

SEQ ID NO: 621 - protein, 8 aa, Artificial Sequence
  Heavy chain CDR3 sequence mut
SHGNYLPL

SEQ ID NO: 622 - protein, 8 aa, Artificial Sequence
  Heavy chain CDR3 sequence mut
SHGNYLPM

SEQ ID NO: 623 - protein, 8 aa, Artificial Sequence
  Heavy chain CDR3 sequence mut
SHGNYLPR

SEQ ID NO: 624 - protein, 8 aa, Artificial Sequence
  Heavy chain CDR3 sequence mut
SHGNYLPS

SEQ ID NO: 625 - protein, 8 aa, Artificial Sequence
  Heavy chain CDR3 sequence mut
SHGNYLPV

SEQ ID NO: 626 - protein, 5 aa, Artificial Sequence
  Light chain CDR1 sequence mut
ASYLH

SEQ ID NO: 627 - protein, 5 aa, Artificial Sequence
  Light chain CDR1 sequence mut
DSYLH

SEQ ID NO: 628 - protein, 5 aa, Artificial Sequence
  Light chain CDR1 sequence mut
FSYLH

SEQ ID NO: 629 - protein, 5 aa, Artificial Sequence
  Light chain CDR1 sequence mut
LSYLH

SEQ ID NO: 630 - protein, 5 aa, Artificial Sequence
  Light chain CDR1 sequence mut
MSYLH

SEQ ID NO: 631 - protein, 5 aa, Artificial Sequence
  Light chain CDR1 sequence mut
RSYLH

SEQ ID NO: 632 - protein, 5 aa, Artificial Sequence
  Light chain CDR1 sequence mut
TSYLH

SEQ ID NO: 633 - protein, 5 aa, Artificial Sequence
  Light chain CDR1 sequence mut
VSYLH

SEQ ID NO: 634 - protein, 5 aa, Artificial Sequence
  Light chain CDR1 sequence mut
WSYLH

SEQ ID NO: 635 - protein, 5 aa, Artificial Sequence
  Light chain CDR1 sequence mut
YSYLH

SEQ ID NO: 636 - protein, 5 aa, Artificial Sequence
  Light chain CDR1 sequence mut
SAYLH

SEQ ID NO: 637 - protein, 5 aa, Artificial Sequence
  Light chain CDR1 sequence mut
SDYLH

SEQ ID NO: 638 - protein, 5 aa, Artificial Sequence
  Light chain CDR1 sequence mut
SEYLH

SEQ ID NO: 639 - protein, 5 aa, Artificial Sequence
  Light chain CDR1 sequence mut
SFYLH

SEQ ID NO: 640 - protein, 5 aa, Artificial Sequence
  Light chain CDR1 sequence mut
SGYLH

SEQ ID NO: 641 - protein, 5 aa, Artificial Sequence
  Light chain CDR1 sequence mut
SHYLH

SEQ ID NO: 642 - protein, 5 aa, Artificial Sequence
  Light chain CDR1 sequence mut
SKYLH

SEQ ID NO: 643 - protein, 5 aa, Artificial Sequence
  Light chain CDR1 sequence mut
SMYLH

SEQ ID NO: 644 - protein, 5 aa, Artificial Sequence
  Light chain CDR1 sequence mut
SNYLH

SEQ ID NO: 645 - protein, 5 aa, Artificial Sequence
  Light chain CDR1 sequence mut
SPYLH

SEQ ID NO: 646 - protein, 5 aa, Artificial Sequence
  Light chain CDR1 sequence mut
SQYLH

SEQ ID NO: 647 - protein, 5 aa, Artificial Sequence
  Light chain CDR1 sequence mut
SVYLH

SEQ ID NO: 648 - protein, 5 aa, Artificial Sequence
  Light chain CDR1 sequence mut
SWYLH

SEQ ID NO: 649 - protein, 5 aa, Artificial Sequence
  Light chain CDR1 sequence mut
SSFLH

SEQ ID NO: 650 - protein, 5 aa, Artificial Sequence
  Light chain CDR1 sequence mut
SSYFH

SEQ ID NO: 651 - protein, 5 aa, Artificial Sequence
  Light chain CDR1 sequence mut
SSYHH

SEQ ID NO: 652 - protein, 5 aa, Artificial Sequence
  Light chain CDR1 sequence mut
SSYIH

SEQ ID NO: 653 - protein, 5 aa, Artificial Sequence
  Light chain CDR1 sequence mut
SSYKH

SEQ ID NO: 654 - protein, 5 aa, Artificial Sequence
  Light chain CDR1 sequence mut
SSYNH

SEQ ID NO: 655 - protein, 5 aa, Artificial Sequence
  Light chain CDR1 sequence mut
SSYPH

SEQ ID NO: 656 - protein, 5 aa, Artificial Sequence
  Light chain CDR1 sequence mut
SSYQH

SEQ ID NO: 657 - protein, 5 aa, Artificial Sequence
  Light chain CDR1 sequence mut
SSYRH

SEQ ID NO: 658 - protein, 5 aa, Artificial Sequence
  Light chain CDR1 sequence mut
SSYSH

SEQ ID NO: 659 - protein, 5 aa, Artificial Sequence
  Light chain CDR1 sequence mut
SSYYH

SEQ ID NO: 660 - protein, 5 aa, Artificial Sequence
  Light chain CDR1 sequence mut
SSYWH

SEQ ID NO: 661 - protein, 5 aa, Artificial Sequence
  Light chain CDR1 sequence mut
SSYYH

SEQ ID NO: 662 - protein, 7 aa, Artificial Sequence
  Light chain CDR2 sequence mut
ATSNLAS

SEQ ID NO: 663 - protein, 7 aa, Artificial Sequence
  Light chain CDR2 sequence mut
HTSNLAS

SEQ ID NO: 664 - protein, 7 aa, Artificial Sequence
  Light chain CDR2 sequence mut
NTSNLAS

SEQ ID NO: 665 - protein, 7 aa, Artificial Sequence
  Light chain CDR2 sequence mut
RTSNLAS

SEQ ID NO: 666 - protein, 7 aa, Artificial Sequence
  Light chain CDR2 sequence mut
SASNLAS

SEQ ID NO: 667 - protein, 7 aa, Artificial Sequence
  Light chain CDR2 sequence mut
SDSNLAS

SEQ ID NO: 668 - protein, 7 aa, Artificial Sequence
  Light chain CDR2 sequence mut
SFSNLAS

SEQ ID NO: 669 - protein, 7 aa, Artificial Sequence
  Light chain CDR2 sequence mut
SGSNLAS

SEQ ID NO: 670 - protein, 7 aa, Artificial Sequence
  Light chain CDR2 sequence mut
SHSNLAS

SEQ ID NO: 671 - protein, 7 aa, Artificial Sequence
  Light chain CDR2 sequence mut
SLSNLAS

SEQ ID NO: 672 - protein, 7 aa, Artificial Sequence
  Light chain CDR2 sequence mut
SMSNLAS

SEQ ID NO: 673 - protein, 7 aa, Artificial Sequence
  Light chain CDR2 sequence mut
SSSNLAS

SEQ ID NO: 674 - protein, 7 aa, Artificial Sequence
  Light chain CDR2 sequence mut
SVSNLAS

SEQ ID NO: 675 - protein, 7 aa, Artificial Sequence
  Light chain CDR2 sequence mut
SWSNLAS

SEQ ID NO: 676 - protein, 7 aa, Artificial Sequence
  Light chain CDR2 sequence mut
SYSNLAS

SEQ ID NO: 677 - protein, 7 aa, Artificial Sequence
  Light chain CDR2 sequence mut
STDNLAS

SEQ ID NO: 678 - protein, 7 aa, Artificial Sequence
  Light chain CDR2 sequence mut
STFNLAS

SEQ ID NO: 679 - protein, 7 aa, Artificial Sequence
  Light chain CDR2 sequence mut
STHNLAS

SEQ ID NO: 680 - protein, 7 aa, Artificial Sequence
  Light chain CDR2 sequence mut
STINLAS

SEQ ID NO: 681 - protein, 7 aa, Artificial Sequence
  Light chain CDR2 sequence mut
STKNLAS

SEQ ID NO: 682 - protein, 7 aa, Artificial Sequence
  Light chain CDR2 sequence mut
STLNLAS

SEQ ID NO: 683 - protein, 7 aa, Artificial Sequence
  Light chain CDR2 sequence mut
STNNLAS

SEQ ID NO: 684 - protein, 7 aa, Artificial Sequence
  Light chain CDR2 sequence mut
STQNLAS

SEQ ID NO: 685 - protein, 7 aa, Artificial Sequence
  Light chain CDR2 sequence mut
STYNLAS

SEQ ID NO: 686 - protein, 7 aa, Artificial Sequence
  Light chain CDR2 sequence mut
STSDLAS

SEQ ID NO: 687 - protein, 7 aa, Artificial Sequence
  Light chain CDR2 sequence mut
STSELAS

SEQ ID NO: 688 - protein, 7 aa, Artificial Sequence
  Light chain CDR2 sequence mut
STSFLAS

SEQ ID NO: 689 - protein, 7 aa, Artificial Sequence
  Light chain CDR2 sequence mut
STSGLAS

SEQ ID NO: 690 - protein, 7 aa, Artificial Sequence
  Light chain CDR2 sequence mut
STSHLAS

SEQ ID NO: 691 - protein, 7 aa, Artificial Sequence
  Light chain CDR2 sequence mut
STSILAS

SEQ ID NO: 692 - protein, 7 aa, Artificial Sequence
  Light chain CDR2 sequence mut
STSKLAS

SEQ ID NO: 693 - protein, 7 aa, Artificial Sequence
  Light chain CDR2 sequence mut
STSQLAS

SEQ ID NO: 694 - protein, 7 aa, Artificial Sequence
  Light chain CDR2 sequence mut
STSRLAS

SEQ ID NO: 695 - protein, 7 aa, Artificial Sequence
  Light chain CDR2 sequence mut
STSSLAS

SEQ ID NO: 696 - protein, 7 aa, Artificial Sequence
  Light chain CDR2 sequence mut
STSVLAS

SEQ ID NO: 697 - protein, 7 aa, Artificial Sequence
  Light chain CDR2 sequence mut
STSNDAS

SEQ ID NO: 698 - protein, 7 aa, Artificial Sequence
  Light chain CDR2 sequence mut
STSNEAS

SEQ ID NO: 699 - protein, 7 aa, Artificial Sequence
  Light chain CDR2 sequence mut
STSNFAS

SEQ ID NO: 700 - protein, 7 aa, Artificial Sequence
  Light chain CDR2 sequence mut
STSNGAS

SEQ ID NO: 701 - protein, 7 aa, Artificial Sequence
  Light chain CDR2 sequence mut
STSNHAS

SEQ ID NO: 702 - protein, 7 aa, Artificial Sequence
  Light chain CDR2 sequence mut
STSNIAS

SEQ ID NO: 703 - protein, 7 aa, Artificial Sequence
  Light chain CDR2 sequence mut
STSNKAS

SEQ ID NO: 704 - protein, 7 aa, Artificial Sequence
  Light chain CDR2 sequence mut
STSNMAS

SEQ ID NO: 705 - protein, 7 aa, Artificial Sequence
  Light chain CDR2 sequence mut
STSNNAS

SEQ ID NO: 706 - protein, 7 aa, Artificial Sequence
  Light chain CDR2 sequence mut
STSNPAS

SEQ ID NO: 707 - protein, 7 aa, Artificial Sequence
  Light chain CDR2 sequence mut
STSNQAS

SEQ ID NO: 708 - protein, 7 aa, Artificial Sequence
  Light chain CDR2 sequence mut
STSNVAS

SEQ ID NO: 709 - protein, 7 aa, Artificial Sequence
  Light chain CDR2 sequence mut
STSNWAS

SEQ ID NO: 710 - protein, 7 aa, Artificial Sequence
  Light chain CDR2 sequence mut
STSNYAS

SEQ ID NO: 711 - protein, 7 aa, Artificial Sequence
  Light chain CDR2 sequence mut
STSNLDS

SEQ ID NO: 712 - protein, 7 aa, Artificial Sequence
  Light chain CDR2 sequence mut
STSNLFS

SEQ ID NO: 713 - protein, 7 aa, Artificial Sequence
  Light chain CDR2 sequence mut
STSNLGS

SEQ ID NO: 714 - protein, 7 aa, Artificial Sequence
  Light chain CDR2 sequence mut
STSNLIS

SEQ ID NO: 715 - protein, 7 aa, Artificial Sequence
  Light chain CDR2 sequence mut
STSNLKS

SEQ ID NO: 716 - protein, 7 aa, Artificial Sequence
  Light chain CDR2 sequence mut
STSNLQS

SEQ ID NO: 717 - protein, 7 aa, Artificial Sequence
  Light chain CDR2 sequence mut
STSNLRS

SEQ ID NO: 718 - protein, 7 aa, Artificial Sequence
  Light chain CDR2 sequence mut
STSNLSS

SEQ ID NO: 719 - protein, 7 aa, Artificial Sequence
  Light chain CDR2 sequence mut
STSNLVS

SEQ ID NO: 720 - protein, 7 aa, Artificial Sequence
  Light chain CDR2 sequence mut
STSNLWS

SEQ ID NO: 721 - protein, 7 aa, Artificial Sequence
  Light chain CDR2 sequence mut
STSNLAA

SEQ ID NO: 722 - protein, 7 aa, Artificial Sequence
  Light chain CDR2 sequence mut
STSNLAD

SEQ ID NO: 723 - protein, 7 aa, Artificial Sequence
  Light chain CDR2 sequence mut
STSNLAF

SEQ ID NO: 724 - protein, 7 aa, Artificial Sequence
  Light chain CDR2 sequence mut
STSNLAG

SEQ ID NO: 725 - protein, 7 aa, Artificial Sequence
  Light chain CDR2 sequence mut
STSNLAH

SEQ ID NO: 726 - protein, 7 aa, Artificial Sequence
  Light chain CDR2 sequence mut
STSNLAK

SEQ ID NO: 727 - protein, 7 aa, Artificial Sequence
  Light chain CDR2 sequence mut
STSNLAL

SEQ ID NO: 728 - protein, 7 aa, Artificial Sequence
  Light chain CDR2 sequence mut
STSNLAR

SEQ ID NO: 729 - protein, 7 aa, Artificial Sequence
  Light chain CDR2 sequence mut
STSNLAT

SEQ ID NO: 730 - protein, 7 aa, Artificial Sequence
  Light chain CDR2 sequence mut
STSNLAV

SEQ ID NO: 731 - protein, 7 aa, Artificial Sequence
  Light chain CDR2 sequence mut
STSNLAW

SEQ ID NO: 732 - protein, 8 aa, Artificial Sequence
  Light chain CDR2 sequence
STSNLASG

SEQ ID NO: 733 - protein, 8 aa, Artificial Sequence
  Light chain CDR2 sequence mut
STSNLASA

SEQ ID NO: 734 - protein, 8 aa, Artificial Sequence
  Light chain CDR2 sequence mut
STSNLASF

SEQ ID NO: 735 - protein, 8 aa, Artificial Sequence
  Light chain CDR2 sequence mut
STSNLASI

SEQ ID NO: 736 - protein, 8 aa, Artificial Sequence
  Light chain CDR2 sequence mut
STSNLASN

SEQ ID NO: 737 - protein, 8 aa, Artificial Sequence
  Light chain CDR2 sequence mut
STSNLASP

SEQ ID NO: 738 - protein, 8 aa, Artificial Sequence
  Light chain CDR2 sequence mut
STSNLASR

SEQ ID NO: 739 - protein, 8 aa, Artificial Sequence
  Light chain CDR2 sequence mut
STSNLASS

SEQ ID NO: 740 - protein, 8 aa, Artificial Sequence
  Light chain CDR2 sequence mut
STSNLAST

SEQ ID NO: 741 - protein, 8 aa, Artificial Sequence
  Light chain CDR2 sequence mut
STSNLASV

SEQ ID NO: 742 - protein, 8 aa, Artificial Sequence
  Light chain CDR2 sequence mut
STSNLASY

SEQ ID NO: 743 - protein, 10 aa, Artificial Sequence
  Light chain CDR3 sequence mut
AQYHRSPPTF

SEQ ID NO: 744 - protein, 10 aa, Artificial Sequence
  Light chain CDR3 sequence mut
CQYHRSPPTF

SEQ ID NO: 745 - protein, 10 aa, Artificial Sequence
  Light chain CDR3 sequence mut
DQYHRSPPTF

SEQ ID NO: 746 - protein, 10 aa, Artificial Sequence
  Light chain CDR3 sequence mut
EQYHRSPPTF

SEQ ID NO: 747 - protein, 10 aa, Artificial Sequence
  Light chain CDR3 sequence mut
FQYHRSPPTF

SEQ ID NO: 748 - protein, 10 aa, Artificial Sequence
  Light chain CDR3 sequence mut
IQYHRSPPTF

SEQ ID NO: 749 - protein, 10 aa, Artificial Sequence
  Light chain CDR3 sequence mut
KQYHRSPPTF

SEQ ID NO: 750 - protein, 10 aa, Artificial Sequence
  Light chain CDR3 sequence mut
LQYHRSPPTF

SEQ ID NO: 751 - protein, 10 aa, Artificial Sequence
  Light chain CDR3 sequence mut
NQYHRSPPTF

SEQ ID NO: 752 - protein, 10 aa, Artificial Sequence
  Light chain CDR3 sequence mut
RQYHRSPPTF

SEQ ID NO: 753 - protein, 10 aa, Artificial Sequence
  Light chain CDR3 sequence mut
SQYHRSPPTF

SEQ ID NO: 754 - protein, 10 aa, Artificial Sequence
  Light chain CDR3 sequence mut
TQYHRSPPTF

SEQ ID NO: 755 - protein, 10 aa, Artificial Sequence
  Light chain CDR3 sequence mut
VQYHRSPPTF

SEQ ID NO: 756 - protein, 10 aa, Artificial Sequence
  Light chain CDR3 sequence mut
WQYHRSPPTF

SEQ ID NO: 757 - protein, 10 aa, Artificial Sequence
  Light chain CDR3 sequence mut
YQYHRSPPTF

SEQ ID NO: 758 - protein, 10 aa, Artificial Sequence
  Light chain CDR3 sequence mut
HAYHRSPPTF

SEQ ID NO: 759 - protein, 10 aa, Artificial Sequence
  Light chain CDR3 sequence mut
HCYHRSPPTF

SEQ ID NO: 760 - protein, 10 aa, Artificial Sequence
  Light chain CDR3 sequence mut
HEYHRSPPTF

SEQ ID NO: 761 - protein, 10 aa, Artificial Sequence
  Light chain CDR3 sequence mut
HGYHRSPPTF

SEQ ID NO: 762 - protein, 10 aa, Artificial Sequence
  Light chain CDR3 sequence mut
HNYHRSPPTF

SEQ ID NO: 763 - protein, 10 aa, Artificial Sequence
  Light chain CDR3 sequence mut
HSYHRSPPTF

SEQ ID NO: 764 - protein, 10 aa, Artificial Sequence
  Light chain CDR3 sequence mut
HTYHRSPPTF

SEQ ID NO: 765 - protein, 10 aa, Artificial Sequence
  Light chain CDR3 sequence mut
HVYHRSPPTF

SEQ ID NO: 766 - protein, 10 aa, Artificial Sequence
  Light chain CDR3 sequence mut
HQAHRSPPTF

SEQ ID NO: 767 - protein, 10 aa, Artificial Sequence
  Light chain CDR3 sequence mut
HQFHRSPPTF

SEQ ID NO: 768 - protein, 10 aa, Artificial Sequence
  Light chain CDR3 sequence mut
HQGHRSPPTF

SEQ ID NO: 769 - protein, 10 aa, Artificial Sequence
  Light chain CDR3 sequence mut
HQHHRSPPTF

SEQ ID NO: 770 - protein, 10 aa, Artificial Sequence
  Light chain CDR3 sequence mut
HQQHRSPPTF

SEQ ID NO: 771 - protein, 10 aa, Artificial Sequence
  Light chain CDR3 sequence mut
HQWHRSPPTF

SEQ ID NO: 772 - protein, 10 aa, Artificial Sequence
  Light chain CDR3 sequence mut
HQYARSPPTF

SEQ ID NO: 773 - protein, 10 aa, Artificial Sequence
  Light chain CDR3 sequence mut
HQYERSPPTF

SEQ ID NO: 774 - protein, 10 aa, Artificial Sequence
  Light chain CDR3 sequence mut
HQYGRSPPTF

SEQ ID NO: 775 - protein, 10 aa, Artificial Sequence
  Light chain CDR3 sequence mut
HQYKRSPPTF

SEQ ID NO: 776 - protein, 10 aa, Artificial Sequence
  Light chain CDR3 sequence mut
HQYLRSPPTF

SEQ ID NO: 777 - protein, 10 aa, Artificial Sequence
  Light chain CDR3 sequence mut
HQYNRSPPTF

SEQ ID NO: 778 - protein, 10 aa, Artificial Sequence
  Light chain CDR3 sequence mut
HQYQRSPPTF

SEQ ID NO: 779 - protein, 10 aa, Artificial Sequence
  Light chain CDR3 sequence mut
HQYSRSPPTF

SEQ ID NO: 780 - protein, 10 aa, Artificial Sequence
  Light chain CDR3 sequence mut
HQYTRSPPTF

SEQ ID NO: 781 - protein, 10 aa, Artificial Sequence
  Light chain CDR3 sequence mut
HQYVRSPPTF

SEQ ID NO: 782 - protein, 10 aa, Artificial Sequence
  Light chain CDR3 sequence mut
HQYWRSPPTF

SEQ ID NO: 783 - protein, 10 aa, Artificial Sequence
  Light chain CDR3 sequence mut
HQYHASPPTF

SEQ ID NO: 784 - protein, 10 aa, Artificial Sequence
  Light chain CDR3 sequence mut
HQYHCSPPTF

SEQ ID NO: 785 - protein, 10 aa, Artificial Sequence
  Light chain CDR3 sequence mut
HQYHDSPPTF

SEQ ID NO: 786 - protein, 10 aa, Artificial Sequence
  Light chain CDR3 sequence mut
HQYHESPPTF

SEQ ID NO: 787 - protein, 10 aa, Artificial Sequence
  Light chain CDR3 sequence mut
HQYHFSPPTF

SEQ ID NO: 788 - protein, 10 aa, Artificial Sequence
  Light chain CDR3 sequence mut
HQYHISPPTF

SEQ ID NO: 789 - protein, 10 aa, Artificial Sequence
  Light chain CDR3 sequence mut
HQYHLSPPTF

SEQ ID NO: 790 - protein, 10 aa, Artificial Sequence
  Light chain CDR3 sequence mut
HQYHMSPPTF

SEQ ID NO: 791 - protein, 10 aa, Artificial Sequence
  Light chain CDR3 sequence mut
HQYHNSPPTF

SEQ ID NO: 792 - protein, 10 aa, Artificial Sequence
  Light chain CDR3 sequence mut
HQYHQSPPTF

SEQ ID NO: 793 - protein, 10 aa, Artificial Sequence
  Light chain CDR3 sequence mut
HQYHVSPPTF

SEQ ID NO: 794 - protein, 10 aa, Artificial Sequence
  Light chain CDR3 sequence mut
HQYHWSPPTF

SEQ ID NO: 795 - protein, 10 aa, Artificial Sequence
  Light chain CDR3 sequence mut
HQYHYSPPTF

SEQ ID NO: 796 - protein, 10 aa, Artificial Sequence
  Light chain CDR3 sequence mut
HQYHRAPPTF

SEQ ID NO: 797 - protein, 10 aa, Artificial Sequence
  Light chain CDR3 sequence mut
HQYHRCPPTF

SEQ ID NO: 798 - protein, 10 aa, Artificial Sequence
  Light chain CDR3 sequence mut
HQYHREPPTF

SEQ ID NO: 799 - protein, 10 aa, Artificial Sequence
  Light chain CDR3 sequence mut
HQYHRFPPTF

SEQ ID NO: 800 - protein, 10 aa, Artificial Sequence
  Light chain CDR3 sequence mut
HQYHRGPPTF

SEQ ID NO: 801 - protein, 10 aa, Artificial Sequence
  Light chain CDR3 sequence mut
HQYHRIPPTF

SEQ ID NO: 802 - protein, 10 aa, Artificial Sequence
  Light chain CDR3 sequence mut
HQYHRMPPTF

SEQ ID NO: 803 - protein, 10 aa, Artificial Sequence
  Light chain CDR3 sequence mut
HQYHRPPPTF

SEQ ID NO: 804 - protein, 10 aa, Artificial Sequence
  Light chain CDR3 sequence mut
HQYHRRPPTF

SEQ ID NO: 805 - protein, 10 aa, Artificial Sequence
  Light chain CDR3 sequence mut
HQYHRTPPTF

SEQ ID NO: 806 - protein, 10 aa, Artificial Sequence
  Light chain CDR3 sequence mut
HQYHRVPPTF

SEQ ID NO: 807 - protein, 10 aa, Artificial Sequence
  Light chain CDR3 sequence mut
HQYHRWPPTF

SEQ ID NO: 808 - protein, 10 aa, Artificial Sequence
  Light chain CDR3 sequence mut
HQYHRYPPTF

SEQ ID NO: 809 - protein, 10 aa, Artificial Sequence
  Light chain CDR3 sequence mut
HQYHRSKPTF

SEQ ID NO: 810 - protein, 10 aa, Artificial Sequence
  Light chain CDR3 sequence mut
HQYHRSWPTF

SEQ ID NO: 811 - protein, 10 aa, Artificial Sequence
  Light chain CDR3 sequence mut
HQYHRSYPTF

SEQ ID NO: 812 - protein, 10 aa, Artificial Sequence
  Light chain CDR3 sequence mut
HQYHRSPDTF

SEQ ID NO: 813 - protein, 10 aa, Artificial Sequence
  Light chain CDR3 sequence mut
HQYHRSPHTF

SEQ ID NO: 814 - protein, 10 aa, Artificial Sequence
  Light chain CDR3 sequence mut
HQYHRSPPDF

SEQ ID NO: 815 - protein, 10 aa, Artificial Sequence
  Light chain CDR3 sequence mut
HQYHRSPPFF

SEQ ID NO: 816 - protein, 10 aa, Artificial Sequence
  Light chain CDR3 sequence mut
HQYHRSPPGF

SEQ ID NO: 817 - protein, 10 aa, Artificial Sequence
  Light chain CDR3 sequence mut
HQYHRSPPIF

SEQ ID NO: 818 - protein, 10 aa, Artificial Sequence
  Light chain CDR3 sequence mut
HQYHRSPPLF

SEQ ID NO: 819 - protein, 10 aa, Artificial Sequence
  Light chain CDR3 sequence mut
HQYHRSPPMF

SEQ ID NO: 820 - protein, 10 aa, Artificial Sequence
  Light chain CDR3 sequence mut
HQYHRSPPNF

SEQ ID NO: 821 - protein, 10 aa, Artificial Sequence
  Light chain CDR3 sequence mut
HQYHRSPPQF

SEQ ID NO: 822 - protein, 10 aa, Artificial Sequence
  Light chain CDR3 sequence mut
HQYHRSPPRF

SEQ ID NO: 823 - protein, 10 aa, Artificial Sequence
  Light chain CDR3 sequence mut
HQYHRSPPSF

SEQ ID NO: 824 - protein, 10 aa, Artificial Sequence
  Light chain CDR3 sequence mut
HQYHRSPPVF

SEQ ID NO: 825 - protein, 10 aa, Artificial Sequence
  Light chain CDR3 sequence mut
HQYHRSPPYF

SEQ ID NO: 826 - DNA, 50 bp, Artificial Sequence
  Apollo_ECL2_h2m_F
ctgcaatctgtttgctcagacattttcccactcattgatgaaacctacct

SEQ ID NO: 827 - DNA, 50 bp, Artificial Sequence
  Apollo_ECL2_h2m_R
ggaaaatgtctgagcaaacagattgcagtttcttgcagttccagcccagg

SEQ ID NO: 828 - protein, 215 aa, Artificial Sequence; identical to SEQ ID NO: 338
  P1C4 Light Chain Parental Sequence

SEQ ID NO: 829 - protein, 215 aa, Artificial Sequence
  P1C4 Clone RY-LC-B12__FACS3
EIVLTQSPATLSLSPGERATLSCRASQSVSSRYLHWYQQKPGQAPRLLIYSTSRLASGIPARFSGSGSGTDFTLTISRLEPEDFAVYYCQQYHRSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 830 - protein, 215 aa, Artificial Sequence
  P1C4 Clone RY-LC-A10__FACS5
EIVLTQSPATLSLSPGERATLSCRASQSVSSRYLHWYQQKPGQAPRLLIYSTSNRASGIPARFSGSGSGTDFTLTISRLEPEDFAVYYCQQYHRSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 831 - protein, 215 aa, Artificial Sequence
  P1C4 Clone RY-HL-LC-C12__FACS4
EIVLTQSPATLSLSPGERATLSCRASQSVSSRYLHWYQQKPGQAPRLLIYSTSRLASGIPARFSGSGSGTDFTLTISRLEPEDFAVYYCHQYHRSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 832 - protein, 215 aa, Artificial Sequence
  P1C4 Clone RY-HL-LC-A12__FACS4
EIVLTQSPATLSLSPGERATLSCRASQSVSSRYLHWYQQKPGQAPRLLIYGTSNLASGIPARFSGSGSGTDFTLTISRLEPEDFAVYYCHQYSRSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 833 - protein, 5 aa, Artificial Sequence
  Light chain CDR1 sequence mut
SRYLH

SEQ ID NO: 834 - protein, 7 aa, Artificial Sequence
  Light chain CDR2 sequence mut
GTSNLAS

SEQ ID NO: 835 - protein, 7 aa, Artificial Sequence
  Light chain CDR2 sequence mut
STSNRAS

SEQ ID NO: 836 - protein, 10 aa, Artificial Sequence
  Light chain CDR3 sequence mut
QQYHRSPPTF

The invention claimed is:

1. An isolated antibody or antigen binding fragment thereof that binds to cannabinoid 1 (CB1) receptor, wherein the antibody or antigen binding fragment thereof comprises a heavy chain CDR1, CDR2, and CDR3 according to SEQ ID NOs: 352, 353, and 354, respectively, and a light chain CDR1, CDR2, and CDR3 according to one of the following:
   (a) SEQ ID NOs: 833, 694, and 836, respectively;
   (b) SEQ ID NOs: 833, 835, and 836, respectively;
   (c) SEQ ID NOs: 833, 694, and 357, respectively; and
   (d) SEQ ID NOs: 833, 834, and 779, respectively.

2. The isolated antibody or antigen binding fragment of claim 1, wherein the antibody or antigen binding fragment thereof comprises a light chain according to SEQ ID NO: 829.

3. The isolated antibody or antigen binding fragment of claim 1, wherein the light chain CDR1, CDR2, and CDR3 according to SEQ ID NOs: 833, 694, and 836, respectively.

4. The isolated antibody or antigen binding fragment of claim 1, wherein the antibody or antigen binding fragment thereof comprises a light chain according to SEQ ID NO: 830.

5. The isolated antibody or antigen binding fragment of claim 1, wherein the light chain CDR1, CDR2, and CDR3 are according to SEQ ID NOs: 833, 835, and 836, respectively.

6. The isolated antibody or antigen binding fragment of claim 1, wherein the antibody or antigen binding fragment thereof comprises a light chain according to SEQ ID NO: 831.

7. The isolated antibody or antigen binding fragment of claim 1, wherein the light chain CDR1, CDR2, and CDR3 are according to SEQ ID NOs: 833, 694, and 357, respectively.

8. The isolated antibody or antigen binding fragment of claim 1, wherein the antibody or antigen binding fragment thereof comprises a light chain according to SEQ ID NO: 832.

9. The isolated antibody or antigen binding fragment of claim 1, wherein the light chain CDR1, CDR2, and CDR3 are according to SEQ ID NOs: 833, 834, and 779, respectively.

10. An isolated antibody or antigen binding fragment thereof that binds to cannabinoid receptor 1 (CB1), wherein the antibody or antigen binding fragment thereof comprises a heavy chain variable region comprising:
    a heavy chain CDR1 comprising an amino acid sequence according to SEQ ID NO: 352;
    a heavy chain CDR2 comprising an amino acid sequence according to SEQ ID NO: 353;
    a heavy chain CDR3 comprising an amino acid sequence according to SEQ ID NO:354;
    a light chain CDR1 comprising an amino acid sequence according to SEQ ID NOs: 355 or 833;
    a light chain CDR2 comprising an amino acid sequence according to SEQ ID NOs: 356, 694, 834, or 835; and
    a light chain CDR3 comprising an amino acid sequence according to SEQ ID NOs: 357, 779, or 836;
    wherein the light chain CDR1, CDR2 and CDR3 are not simultaneously SEQ ID NO:355, 356 and 357.

11. The isolated antibody or fragment of claim 1, wherein the antibody or antigen binding fragment thereof is a humanized antibody.

12. The isolated antibody or antigen binding fragment of claim 1, wherein the antibody or antigen binding fragment thereof comprises a modified Fc region.

13. The isolated antibody or antigen binding fragment of claim 1, wherein the antibody is conjugated to an agent, for example, an additional therapeutic agent, a cytotoxic agent, an immunoadhesion molecule, or an imaging agent.

14. A method reducing CB1 receptor signaling a subject in need thereof, wherein the subject has obesity, type 2 diabetes, fibrosis, and non-alcoholic steatohepatitis (NASH), the method comprising administering to the subject an antibody or antigen binding fragment of claim 1.

15. A method for measuring CB1 receptor signaling in a cell, the method comprising:
    measuring an amount of CB1 receptor signaling activity prior to contacting a cell with an antibody or antigen binding fragment of claim 1;
    contacting a cell with an antibody or antigen binding fragment of claim 1; and
    measuring the amount of CB1 receptor signaling after contacting a cell with an antibody or antigen binding fragment of claim 1.

16. A method for detecting CB1 receptor, comprising:
    contacting a cell with an antibody or antigen binding fragment of claim 1 that has an attached imaging agent; and
    detecting binding of the antibody or antigen binding fragment with attached imaging agent to CB1 receptor; or
    contacting a cell with an antibody or antigen binding fragment of claim 1;
    contacting a cell with a secondary antibody that binds the antibody or antigen binding fragment of claim 1 which secondary antibody has an attached imaging agent; and
    detecting binding of the antibody or antigen binding fragment of claim 1 to CB1 receptor by detecting the imaging agent attached to a secondary antibody that binds to the antibody or antigen binding fragment of claim 1.

17. The method of claim 14, wherein the subject has obesity.

18. The method of claim 14, wherein subject has type 2 diabetes.

19. The method of claim 14, wherein the subject has liver fibrosis.

20. The method of claim 14, wherein the subject has NASH.

21. The method of claim 14, wherein the subject has kidney fibrosis.

22. The method of claim 16, wherein the imaging agent is selected from the group consisting of a radiolabel, an enzyme, a fluorescent label, a luminescent label, a bioluminescent label, a magnetic label, and biotin.

23. The isolated antibody or antigen binding fragment of claim 2, wherein the antibody or antigen binding fragment thereof comprises a heavy chain according to SEQ ID NO: 437.

24. The isolated antibody or antigen binding fragment of claim 4, wherein the antibody or antigen binding fragment thereof comprises a heavy chain according to SEQ ID NO: 437.

25. The isolated antibody or antigen binding fragment of claim 6, wherein the antibody or antigen binding fragment thereof comprises a heavy chain according to SEQ ID NO: 437.

26. The isolated antibody or antigen binding fragment of claim 8, wherein the antibody or antigen binding fragment thereof comprises a heavy chain according to SEQ ID NO: 437.

\* \* \* \* \*